US010988745B2

(12) United States Patent
Posada et al.

(10) Patent No.: US 10,988,745 B2
(45) Date of Patent: Apr. 27, 2021

(54) THERAPEUTIC NUCLEASE-ALBUMIN FUSIONS AND METHODS

(71) Applicant: RESOLVE THERAPEUTICS, LLC, Seattle, WA (US)

(72) Inventors: James Arthur Posada, May, ID (US); Chris Gabel, Seattle, WA (US)

(73) Assignee: RESOLVE THERAPEUTICS, LLC, St. Petersburg, FL (US)

( * ) Notice: Subject to any disclaimer, the term of this patent is extended or adjusted under 35 U.S.C. 154(b) by 0 days.

(21) Appl. No.: 15/032,581

(22) PCT Filed: Oct. 31, 2014

(86) PCT No.: PCT/US2014/063572
§ 371 (c)(1),
(2) Date: Jul. 27, 2016

(87) PCT Pub. No.: WO2015/066550
PCT Pub. Date: May 7, 2015

(65) Prior Publication Data
US 2016/0251638 A1 Sep. 1, 2016

Related U.S. Application Data

(60) Provisional application No. 61/898,370, filed on Oct. 31, 2013, provisional application No. 61/898,393, filed on Oct. 31, 2013, provisional application No. 61/898,384, filed on Oct. 31, 2013.

(51) Int. Cl.
C07K 16/12 (2006.01)
C12N 9/22 (2006.01)
C07K 14/765 (2006.01)
A61K 38/00 (2006.01)
A61K 38/46 (2006.01)

(52) U.S. Cl.
CPC .............. C12N 9/22 (2013.01); C07K 14/765 (2013.01); C12Y 301/21001 (2013.01); C12Y 301/27005 (2013.01); A61K 38/00 (2013.01); A61K 38/465 (2013.01); C07K 2319/00 (2013.01); C07K 2319/31 (2013.01)

(58) Field of Classification Search
None
See application file for complete search history.

(56) References Cited

U.S. PATENT DOCUMENTS

| 3,773,919 A | 11/1973 | Boswell et al. |
| 3,941,763 A | 3/1976 | Sarantakis |
| 4,683,195 A | 7/1987 | Mullis et al. |
| 4,683,202 A | 7/1987 | Mullis |
| 4,800,159 A | 1/1989 | Mullis et al. |
| 4,965,188 A | 10/1990 | Mullis et al. |
| 5,428,130 A | 6/1995 | Capon et al. |
| 5,453,269 A | 9/1995 | Haber et al. |
| 5,559,212 A | 9/1996 | Ardelt |
| 5,637,481 A | 6/1997 | Ledbetter et al. |
| 5,648,260 A | 7/1997 | Winter et al. |
| 5,658,570 A | 8/1997 | Newman et al. |
| 5,739,277 A | 4/1998 | Presta et al. |
| 5,834,250 A | 11/1998 | Wells et al. |
| 5,840,296 A | 11/1998 | Raines et al. |
| 5,840,840 A | 11/1998 | Rybak et al. |
| 5,869,046 A | 2/1999 | Presta et al. |
| 5,876,969 A * | 3/1999 | Fleer ................ A61K 38/21 435/252.3 |
| 5,955,073 A | 9/1999 | Rybak et al. |
| 5,973,116 A | 10/1999 | Epenetos et al. |
| 5,989,830 A | 11/1999 | Davis et al. |
| 6,096,871 A | 8/2000 | Presta et al. |
| 6,121,022 A | 9/2000 | Presta et al. |
| 6,175,003 B1 | 1/2001 | Saxena |
| 6,194,551 B1 | 2/2001 | Idusogie et al. |
| 6,239,257 B1 | 5/2001 | Ardelt |
| 6,242,195 B1 | 6/2001 | Idusogie et al. |
| 6,277,375 B1 | 8/2001 | Ward |
| 6,280,991 B1 | 8/2001 | Raines |
| 6,348,343 B2 | 2/2002 | Lazarus et al. |
| 6,391,607 B1 | 5/2002 | Lazarus et al. |

(Continued)

FOREIGN PATENT DOCUMENTS

| CL | 2013-02438 | 8/2014 |
| CN | 1852976 A | 10/2006 |

(Continued)

OTHER PUBLICATIONS

Altschul et al., "Gapped BLAST and PSI-BLAST: a new generation of protein database search programs," Nucleic Acids Res., vol. 25:3389-3402 (1997).
Beintema J.J. et al., "Differences in Glycosylation Pattern of Human Secretory Ribonucleases," Biochem. J., vol. 255: 501-505 (1988).
Berland, R., et al., "Toll-like Receptor 7-Dependent Loss of B Cell Tolerance in Pathogenic Auto antibody Knockin Mice," Immunity, vol. 25:429-440 (2006).
Bitonti, A.J. et al., "Pulmonary Delivery of an Erythropoietin Fc Fusion Protein in Non-Human Primates Through an Immunolobulin Transport Pathway," PNAS, vol. 101(26): 9763-9768 (2004).
Boix, E. et al., "Mammalian Antimicrobial Proteins and Peptides: Overview on the RNase A Superfamily Members Involved in Innate Host Defence," Molecular BioSystems, vol. 3: 317-335 (2007).
Brekke, O.H. et al., "Human IgG Isotype-Specific Amino Acid Residues Affecting Complement-Mediated Cell Lysis and Phagocytosis," European Journal of Immunology, vol. 24:2542-2547 (1994).

(Continued)

Primary Examiner — Hope A Robinson
(74) Attorney, Agent, or Firm — Nelson Mullins Riley & Scarborough LLP; Amy E. Mandragouras, Esq.; Erika L. Wallace

(57) ABSTRACT

The invention provides for hybrid nuclease-albumin molecules with increased pharmacokinetic properties. The hybrid nuclease-albumin molecules of the invention have one or more nuclease domains (e.g., an RNase and/or DNase domain) operably coupled to an albumin, or a variant or fragment thereof. The invention also provides methods of treating or preventing a condition associated with an abnormal immune response.

54 Claims, 15 Drawing Sheets
Specification includes a Sequence Listing.

(56) References Cited

U.S. PATENT DOCUMENTS

| | | |
|---|---|---|
| 6,482,626 B2 | 11/2002 | Baker et al. |
| 6,528,624 B1 | 3/2003 | Idusogie et al. |
| 6,538,124 B1 | 3/2003 | Idusogie et al. |
| 6,653,104 B2 | 11/2003 | Goldenberg |
| 6,660,843 B1 | 12/2003 | Feige et al. |
| 6,686,179 B2 * | 2/2004 | Fleer ............... A61K 38/21 435/252.3 |
| 6,716,974 B1 | 4/2004 | Maciag et al. |
| 6,737,056 B1 | 5/2004 | Presta |
| 6,821,505 B2 | 11/2004 | Ward |
| 6,998,253 B1 | 2/2006 | Presta et al. |
| 7,033,572 B2 | 4/2006 | Goldenberg |
| 7,067,298 B2 | 6/2006 | Latham et al. |
| 7,074,592 B2 | 7/2006 | Ashkenazi et al. |
| 7,083,784 B2 | 8/2006 | Dall'Acqua et al. |
| 7,098,016 B2 | 8/2006 | Raines et al. |
| 7,118,751 B1 | 10/2006 | Ledbetter et al. |
| 7,247,302 B1 | 7/2007 | Rosok et al. |
| 7,317,091 B2 | 1/2008 | Lazar et al. |
| 7,364,731 B2 | 4/2008 | Idusogie et al. |
| 7,407,785 B2 | 8/2008 | Lazarus et al. |
| 7,416,875 B2 | 8/2008 | Raines et al. |
| 7,544,487 B2 | 6/2009 | Goldenberg et al. |
| 7,655,757 B2 | 2/2010 | Raines et al. |
| 7,662,925 B2 | 2/2010 | Lazar et al. |
| 7,754,208 B2 | 7/2010 | Ledbetter et al. |
| 7,754,209 B2 | 7/2010 | Ledbetter et al. |
| 7,807,409 B2 | 10/2010 | Kopetzki |
| 7,829,084 B2 | 11/2010 | Ledbetter et al. |
| 8,029,782 B2 | 10/2011 | Klink et al. |
| 8,067,548 B2 | 11/2011 | Wang et al. |
| 8,642,752 B2 | 2/2014 | Swayze et al. |
| 8,697,065 B2 | 4/2014 | Strong et al. |
| 8,841,416 B2 | 9/2014 | Ledbetter et al. |
| 8,937,157 B2 | 1/2015 | Ledbetter et al. |
| 9,790,479 B2 | 10/2017 | Ledbetter et al. |
| 10,000,745 B2 | 6/2018 | Ledbetter et al. |
| 10,202,588 B2 | 2/2019 | Ledbetter et al. |
| 2002/0103125 A1 | 8/2002 | Ashkenazi et al. |
| 2004/0132101 A1 | 7/2004 | Lazar et al. |
| 2005/0054832 A1 | 3/2005 | Lazar et al. |
| 2005/0136049 A1 | 6/2005 | Ledbetter et al. |
| 2005/0158307 A1 | 7/2005 | Spies et al. |
| 2005/0175614 A1 | 8/2005 | Ledbetter et al. |
| 2005/0180970 A1 | 8/2005 | Ledbetter et al. |
| 2005/0186216 A1 | 8/2005 | Ledbetter et al. |
| 2005/0202012 A1 | 9/2005 | Ledbetter et al. |
| 2005/0202023 A1 | 9/2005 | Ledbetter et al. |
| 2005/0202028 A1 | 9/2005 | Ledbetter et al. |
| 2005/0202534 A1 | 9/2005 | Ledbetter et al. |
| 2005/0238646 A1 | 10/2005 | Ledbetter et al. |
| 2006/0040262 A1 | 2/2006 | Morris et al. |
| 2006/0235208 A1 | 10/2006 | Lazar et al. |
| 2006/0263774 A1 | 11/2006 | Clark et al. |
| 2007/0025982 A1 | 2/2007 | Ledbetter et al. |
| 2007/0059306 A1 | 3/2007 | Grosmaire et al. |
| 2007/0105127 A1 | 5/2007 | Gerngross |
| 2007/0111281 A1 | 5/2007 | Sondermann et al. |
| 2007/0231329 A1 | 10/2007 | Lazar et al. |
| 2007/0237765 A1 | 10/2007 | Lazar et al. |
| 2007/0237766 A1 | 10/2007 | Lazar et al. |
| 2007/0237767 A1 | 10/2007 | Lazar et al. |
| 2007/0237779 A1 | 10/2007 | Ledbetter et al. |
| 2007/0243188 A1 | 10/2007 | Lazar et al. |
| 2007/0248603 A1 | 10/2007 | Lazar et al. |
| 2007/0286859 A1 | 12/2007 | Lazar et al. |
| 2008/0057056 A1 | 3/2008 | Lazar et al. |
| 2008/0181892 A1 | 7/2008 | Ledbetter et al. |
| 2008/0227958 A1 | 9/2008 | Thompson et al. |
| 2008/0242845 A1 | 10/2008 | Lazar et al. |
| 2008/0274958 A1 | 11/2008 | DeFrees |
| 2008/0279850 A1 | 11/2008 | Brady et al. |
| 2008/0293121 A1 | 11/2008 | Lazarus et al. |
| 2009/0148447 A1 | 6/2009 | Ledbetter et al. |
| 2009/0175867 A1 | 7/2009 | Thompson et al. |
| 2009/0196870 A1 | 8/2009 | Ledbetter et al. |
| 2009/0214539 A1 | 8/2009 | Grosmaire et al. |
| 2009/0258005 A1 | 10/2009 | Gill et al. |
| 2009/0274692 A1 | 11/2009 | Tan et al. |
| 2010/0015661 A1 | 1/2010 | Dubel et al. |
| 2010/0034820 A1 | 2/2010 | Ledbetter et al. |
| 2010/0099101 A1 | 4/2010 | Behrens et al. |
| 2010/0203052 A1 | 8/2010 | Ledbetter et al. |
| 2010/0279932 A1 | 11/2010 | Ledbetter et al. |
| 2010/0330089 A1 | 12/2010 | Damle et al. |
| 2011/0015451 A1 | 1/2011 | Witte |
| 2011/0033483 A1 | 2/2011 | Thompson et al. |
| 2011/0081345 A1 | 4/2011 | Moore et al. |
| 2011/0091461 A1 | 4/2011 | Ledbetter et al. |
| 2011/0105729 A1 | 5/2011 | Ledbetter et al. |
| 2011/0123440 A1 | 5/2011 | Hansen et al. |
| 2011/0151515 A1 | 6/2011 | Heifetz et al. |
| 2011/0171208 A1 | 7/2011 | Tan et al. |
| 2011/0171218 A1 | 7/2011 | Seehra et al. |
| 2012/0022506 A1 | 1/2012 | Rickard et al. |
| 2012/0225066 A1 | 9/2012 | Ledbetter et al. |
| 2013/0089546 A1 | 4/2013 | Ledbetter et al. |
| 2013/0177561 A1 | 7/2013 | Ledbetter et al. |
| 2013/0183308 A1 | 7/2013 | Ledbetter et al. |
| 2013/0184334 A1 | 7/2013 | Ledbetter et al. |
| 2014/0044711 A1 | 2/2014 | Ledbetter et al. |
| 2014/0178379 A1 | 6/2014 | Ledbetter et al. |
| 2014/0178479 A1 | 6/2014 | Bakhru et al. |
| 2014/0227269 A1 | 8/2014 | Ledbetter et al. |
| 2015/0037871 A1 | 2/2015 | Ledbetter et al. |
| 2015/0152399 A1 | 6/2015 | Ledbetter et al. |
| 2018/0187174 A1 | 7/2018 | Ledbetter et al. |
| 2019/0119660 A1 | 4/2019 | Ledbetter et al. |

FOREIGN PATENT DOCUMENTS

| | | |
|---|---|---|
| CN | 101990439 A | 3/2011 |
| CN | 102770533 A | 11/2012 |
| DE | 102005009219 A1 | 8/2006 |
| EP | 0036676 A1 | 9/1981 |
| EP | 0058481 A1 | 8/1982 |
| EP | 0088046 A2 | 9/1983 |
| EP | 0133988 A2 | 3/1985 |
| EP | 0143949 A1 | 6/1985 |
| EP | 1277716 A1 | 1/2003 |
| GB | 1136039 A | 12/1968 |
| JP | 2004-525630 A | 8/2004 |
| JP | 2006-512407 A | 4/2006 |
| JP | 2007-525443 A | 9/2007 |
| JP | 2013-509201 A | 3/2013 |
| JP | 2014-519809 A | 8/2014 |
| JP | 60634050 B2 | 1/2017 |
| WO | 87/05330 A1 | 9/1987 |
| WO | 8807089 A1 | 9/1988 |
| WO | 1993/015722 A1 | 8/1993 |
| WO | 1994/020069 A1 | 9/1994 |
| WO | 96/14339 A1 | 5/1996 |
| WO | 96/26279 A1 | 8/1996 |
| WO | 98/05787 A1 | 2/1998 |
| WO | 98/23289 A1 | 6/1998 |
| WO | 99/25044 A1 | 5/1999 |
| WO | 9951642 A1 | 10/1999 |
| WO | 99/58572 A1 | 11/1999 |
| WO | 00/09560 A2 | 2/2000 |
| WO | 00/32767 A1 | 6/2000 |
| WO | 0042072 A2 | 7/2000 |
| WO | 01/02440 A1 | 1/2001 |
| WO | 01/79271 A1 | 10/2001 |
| WO | 02/44215 A2 | 6/2002 |
| WO | 02/060919 A2 | 8/2002 |
| WO | 02/060955 A2 | 8/2002 |
| WO | 02072605 A2 | 9/2002 |
| WO | 02/096948 A2 | 12/2002 |
| WO | 03/074569 A2 | 9/2003 |
| WO | 2004016750 A2 | 2/2004 |
| WO | 2004029207 A2 | 4/2004 |
| WO | 2004035752 A2 | 4/2004 |
| WO | 2004063351 A2 | 7/2004 |
| WO | 2004074455 A2 | 9/2004 |

(56) References Cited

FOREIGN PATENT DOCUMENTS

| WO | 2004099249 A2 | 11/2004 |
|---|---|---|
| WO | 05/018572 A2 | 3/2005 |
| WO | 2005/047327 A2 | 5/2005 |
| WO | 2005040217 A2 | 5/2005 |
| WO | 05/063815 A2 | 7/2005 |
| WO | 2005063808 A1 | 7/2005 |
| WO | 2005/077981 A2 | 8/2005 |
| WO | 2005070963 A1 | 8/2005 |
| WO | 2005/080586 A1 | 9/2005 |
| WO | 2005092925 A2 | 10/2005 |
| WO | 05/123780 A2 | 12/2005 |
| WO | 06/019447 A1 | 2/2006 |
| WO | 06/047350 A2 | 5/2006 |
| WO | 06/085967 A2 | 8/2006 |
| WO | 07/122511 A2 | 11/2007 |
| WO | 2007/141580 A2 | 12/2007 |
| WO | 2008/037311 A1 | 4/2008 |
| WO | 2009/015345 A1 | 1/2009 |
| WO | 2009/019314 A1 | 2/2009 |
| WO | 2009/064777 A2 | 5/2009 |
| WO | 2010/092135 A2 | 8/2010 |
| WO | 11/053982 A2 | 5/2011 |
| WO | 2011/051489 A2 | 5/2011 |
| WO | 2011112471 A2 | 9/2011 |
| WO | 2011/124718 A1 | 10/2011 |
| WO | 2012/149440 A2 | 11/2012 |

OTHER PUBLICATIONS

Brekke, O.H. et al., "Therapeutic Antibodies for Human Diseases at the Dawn of the Twenty-First Century," Nature Reviews, vol. 2: 52-62 (2003).
Canfield et al., "The Binding Affinity of Human IgG for its High Affinity Fc Receptor Is Determined by Multiple Amino Acids in the CH2 Domain and is Modulated by the Hinge Region," J. Exp. Med., vol. 173:1483-1491 (1991).
Carsana, A. et al., "Structure of the bovine pancreatic ribonuclease gene: the unique intervening sequence in the 5' untranslated region contains a promoter-like element," Nucl. Acids Res. vol. 16(12):5491-550 (1988).
Chan, A.C. et al., "Therapeutic Antibodies for Autoimmunity and Inflammation," Nature Reviews Immunology, vol. 10:301-316 (2010).
Clark, E.A. et al., "CD16-Mediated Antibody Dependent Cellular Cytotoxicity is Required for B Cell Depletion by a Small Modular ImmunoPharmaceutical Specific for CD20," Blood, Abstract#2388, vol. 102, No. 11:646a (2003).
Davis, Jr., J.C. et al., "Recombinant Human Dnase I (rhDNase) in Patients with Lupus Nephritis," Lupus, vol. 8:68-76 (1999).
Dubel, S., "Novel Recombinant Antibody Constructs and Fusion Proteins for Therapy and Research," Department of Biotechnology, Technical University of Braunschweig, Germany, Jun. 17, 2008, 15 pages.
Dwyer, M.A. et al., "Expression and Characterization of a DNase I—Fc Fusion Enzyme," The Journal of Biological Chemistry, vol. 274 (14):9738-9743 (1999).
European Extended Search Report, European Application No. 12777116.0, dated Jun. 3, 2015, 7 pages.
European Extended Search Report, European Application No. 16198956.1, dated May 4, 2017, 8 pages.
Fenton et al., "Anti-dsDNA Antibodies Promote Initiation, and Acquired Loss of Renal Dnase1 Promotes Progression of Lupus Nephritis in Autoimmune (NZBxNZW)F1 Mice," PloS One, vol. 4, No. 12:e8474 (2009).
Fujihara et al., "Comparative Biochemistry and Physiology", Part B, 163: 263-273 (2012).
Gavalchin, J. et al., "The NZB X SWR Model of Lupus Nephritis, I. Cross-Reactive Idiotypes of Monoclonal Anti-DNA Antibodies in Relation to Antigenic Specificity, Charge, and Allotype. Identification of Interconnected Idiotype Families Inherited from the Normal SWR and the Autoimmune NZB Parents," The Journal of Immunology, vol. 138:128-137 (1987).
GenBank Accession No. CAA11830, Nov. 20, 1998, 2 pages, [Online] Retrieved from the Internet<URL:http://www.ncbi.nlm.nih.giv/protein/CAA11830.
GenBank Accession No. CAA55817.1 (May 20, 1994), Filipenko, M.L.et al., NCBI Sequence Viewer v2.0, 3 pages, [online] [Retrieved on Dec. 12, 2013] Retrieved from the Internet at <URL:http://www.ncbi.nlm.nih.gov/protein/CAA55817.1, pp. 1-3.
Gillies, S.D. et al., "Improving the Efficacy of Antibody-Interleukin 2 Fusion Proteins by Reducing Their Interaction with Fc Receptors," Cancer Research, vol. 59:2159-2166 (1999).
Guo, J. et al., "Clinical Applications of DNaseq," International Journal of Pathology and Clinical Medicine, vol. 29, No. 2:125-129 (2009) (with English abstract).
International Search Report and Written Opinion, PCT Application No. PCT/US10/55131, dated Apr. 29, 2011, 19 pages.
International Search Report and Written Opinion, PCT Application No. PCT/US12/35614, dated Sep. 4, 2012, 17 pages.
Invitation to Pay Additional Fees, and, Where Applicable, Protest Fee, PCT Application No. PCT/US10/55131, dated Feb. 9, 2011, 2 pages.
Jefferis, R. et al., "Interaction Sites on Human IgG-Fc for FcyR: Current Models," Immunology Letters, vol. 82, No. 1-2: 57-65 (2002).
Johnson, R.J. et al., "Inhibition of Human Pancreatic Ribonuclease by the Human Ribonuclease Inhibitor Protein," J. Mol. Biol., vol. 368:434-449 (2007).
Karasinska, J.M., "Searching for the Aircardi-Goutieres Syndrome Genes: TREX1 and Ribonuclease H2 Make the Cut," Clin. Genet., vol. 70:457-461 (2006).
Lazarus et al., "Expression and Characterization of a DNase I-Fc Fusion Enzyme," JBC, 274;14;9738-9743 (1999).
Ledbetter, J.A., "Discovery of Biological Drugs: Seattle at the Leading Edge," Grand Rounds, Department of Medicine, University of Washington, Feb. 4, 2010, 36 pages.
Linsley, P.S. et al., "CTLA-4 is a Second Receptor for the B Cell Activation Antigen B7," J. Exp. Med., vol. 174: 561-569 (1991).
List, E. et al., "Endocrine Parameters and Phenotypes of the Growth Hormone Receptor Gene Disrupted (GHR/) Mouse," Endocrine Reviews, vol. 32: 356-386 (2011).
Lovgren, T. et al., "Induction of Interferon-a by Immune Complexes or Liposomes Containing Systemic Lupus Erythematosus Autoantigen- and Sjogren's Syndrome Autoantigen-Associated RNA," Arthritis & Rheumatism, vol. 54, No. 6:1917-1927 (2006).
Macanovic, M. et al., "The Treatment of Systemic Lupus Erythematosus (SLE) in NZB/W F.sub.1 Hybrid Mice; Studies with Recombinant Murine DNase and with Dexamethasone," Clinical and Experimental Immunology, vol. 106, No. 2: 243-242 (1996).
Martinez-Valle, F. et al., "DNase 1 Activity in Patients with Systemic Lupus Erythematosus: Relationship with Epimediological, Clinical Immunological and Therapeutical Features," Lupus, vol. 18: 418-423 (2009).
Menzel, et al., "Human Antibody RNase Fusion Protein Targeting CD30.sup.+ Lymphomas," Blood, Apr. 1, vol. 11, No. 7: 3830-3837 (2008).
Ni, Y. et al., "Research Progress of DNaseq," International Journal of Pathology and Clinical Medicine, vol. 26, No. 6: 531-535 (2006).
Nuclease (biology), Brittanica Online Encyclopedia, 1 page, [Online] [Retrieved on Feb. 20, 2013], Retrieved from the Internet<URL:http://www.britannica.com/EBchecked/topic/421887/nuclease-?sections=421887main&vie . . . .
European Extended Search Report, European Application No. 10827655.1, dated Jun. 24, 2013, 11 pages.
Pan, C.Q. et al., "Ca.sup.2+-Dependent Activity of Human DNase I and Its Hyperactive Variants," Protein Science, vol. 8:1780-1788 (1999).
Prince, W.S. et al., "Pharmacodynamics of Recombinant Human DNase I in Serum," Clin. Exp. Immunol., vol. 113: 289-296 (1998).
Shak, S. et al., "Recombinant Human DNase I Reduces the Viscosity of Cystic Fibrosis Sputum," Proc. Natl. Acad. Sci., vol. 87: 9188-9192 (1990).

(56) References Cited

OTHER PUBLICATIONS

Skolnick, J. et al., "From Genes to Protein Structure and Function: Novel Applications of Computational Approaches in the Genomic Era," Tibtech, vol. 18:34-39 (2000).
Sondermann, P. et al., "The 3.2 ANG Crystal Structure of the Human IgG1 Fc Frahment-FcyRIII Complex," Nature, vol. 406, No. 6793:267-273 (2000).
Stavenhagen, J.B. et al., "Fc Optimization of Therapeutic Antibodies Enhances Their Ability to Kill Tumor Cells in Vitro and Controls Tumor Expansion in Vivo via Lof-Affinity Activating Fcy Receptors," Cancer Research, vol. 67:8882-8890 (2007).
Strohl, W.R., "Optimization of Fc-mediated effector functions of monoclonal antibodies," Curr. Opin. Biotechnol., vol. 20:685-691 (2009).
Sun, X. et al., "Increased RNase Expression Reduces Inflammation and Prolongs Survival in TLR7 Transgenic Mice," The Journal of Immunology, Feb. 4, 2013, 9 pages.
Tilley et al., "Proteins: Chemistry and Chemical Reactivity," Wiley Encyclopedia of Chemical Biology—Begley—Wiley Online Library, p. 1-16 (2008).
Video of Medicine Grand Rounds on Feb. 4, 2010 by Jeffrey Ledbetter, Research Professor of Medicine, Division of Rheumatology; Affiliate Associate Professor of Microbiology University of Washington School of Medicine, Can be Viewed at<http://depts.washington.edu/medweb/conferences/GRarchive.html#ledbetter>.
U.S. Appl. No. 13/197,731, filed Aug. 3, 2011, Jeffrey A. Ledbetter.
U.S. Appl. No. 13/799,854, filed Mar. 13, 2013, Jeffrey A. Ledbetter.
U.S. Appl. No. 13/799,843, filed Mar. 13, 2013, Jeffrey A. Ledbetter.
U.S. Appl. No. 14/516,161, filed Oct. 16, 2014, Jeffrey A. Ledbetter.
U.S. Appl. No. 13/505,421, filed Jul. 16, 2012, Jeffrey A. Ledbetter.
U.S. Appl. No. 13/796,730, filed Mar. 12, 2013, Jeffrey A. Ledbetter.
U.S. Appl. No. 14/258,319, filed Apr. 22, 2014, Jeffrey A. Ledbetter.
U.S. Appl. No. 13/822,215, filed Mar. 11, 2013, Jeffrey A. Ledbetter.
U.S. Appl. No. 14/174,167, filed Feb. 6, 2014, Jeffrey A. Ledbetter.
U.S. Appl. No. 14/599,567, filed Jan. 19, 2015, Jeffrey A. Ledbetter.
U.S. Appl. No. 13/197,731, May 15, 2014, C. Dahle.
U.S. Appl. No. 13/197,731, Dec. 16, 2013, C. Dahle.
U.S. Appl. No. 13/197,731, Feb. 27, 2013, C. Dahle.
U.S. Appl. No. 13/197,731, Nov. 16, 2012, C. Dahle.
U.S. Appl. No. 13/197,731, Aug. 17, 2012, C. Dahle.
U.S. Appl. No. 13/197,731, Aug. 3, 2012, C. Dahle.
U.S. Appl. No. 13/505,421, Jun. 12, 2014, C. Dahle.
U.S. Appl. No. 13/505,421, Oct. 22, 2013, C. Dahle.
U.S. Appl. No. 13/505,421, Aug. 6, 2013, C. Dahle.
U.S. Appl. No. 13/505,421, Apr. 16, 2013, C. Dahle.
U.S. Appl. No. 14/174,167, Nov. 12, 2014, C. Dahle.
U.S. Appl. No. 14/174,167, Aug. 25, 2014, C. Dahle.
U.S. Appl. No. 14/174,167, May 8, 2014, C. Dahle.
U.S. Appl. No. 14/174,167, Apr. 15, 2014, C. Dahle.
U.S. Appl. No. 14/599,567, Apr. 6, 2017, C. Dahle.
Ahlin et al., "Auto antibodies associated with RNA are more enriched than anti-dsDNA antibodies in circulating immune complexes in SLE," Lupus, 21:586-95 (2012).
Altschul, S. et al., "Basic local alignment search tool," J Mol Biol., vol. 215:403-410 (1990).
Aplin et al., "Preparation, properties, and applications of carbohydrate conjugates of proteins and lipids," CRC Crit Rev Biochem, 259-306 (1981).
Arai, R. et al., "Design of the linkers which effectively separate domains of a bifunctional fusion protein," Protein Eng, vol. 14:529-532 (2001).
Batzer, M. et al., "Enhanced evolutionary PCR using oligonucleotides with inosine at the 3'-terminus," Nucleic Acid Res, vol. 19:5081-5082 (1991).
Carlson et al., "Alloalbuminemia in Sweden: structural study and phenotypic distribution of nine albumin variants," PNAS, 89:8225-9 (1992).
Carlsson J. et al., "Protein thiolation and reversible Protein-Protein Conjugation N-Succinimidyl 3-(2-Pyridyldithio) Propionate, A New Heterobifunctional Reagent," Journal Biochemical, Portland Press, Ltd., GB, vol. 173(3):723-737 (1978).
Chen, X. et al., "Effects of Receptor Binding on Plasma Half-life of Bifunctional Transferrin Fusion Proteins," Mol Pharm, 8(2):457-465 (2011).
Chiang, E. et al., "Immune complex-mediated cell activation from Systemic Lupus Erythematosus and rheumatoid arthritis patients elaborate different requirements for IRAK1/4 kinase activity across human cell types," J Immunol 186:1279-1288 (2011).
Database Biosis [Online] Biosciences Information Service, Philadelphia, PA, US; 1989, Goryacheva L K et al., "The Effect of Chemical Modification of Rnase a With Human Serum Albumin on Its Catalytic Properti Es," XP002736027, Database accession No. PREV199089069645 (abstract).
Database Biosis [Online] Biosciences Information Service, Philadelphia, PA, US; 1990, Goryacheva L K et al., "Heterooligoproteins Containing Pancreatic Rnase as Enzyme Conjugates With Long-Term Effect," XP002736026, Database accession No. PREV199191088476 (abstract).
Dockal, M. et al., "The three recombinant domains of human serum albumin," JBC, 274(41):29303-29310 (1999).
Eppstein, D. et al., "Biological activity of liposome-encapsulated murine interferon y is mediated by a cell membrane receptor," PNAS, 82:3688-3692 (1985).
George, R. et al., "An analysis of protein domain linkers: their classification and role in protein folding," Protein Engineering, 15(11):871-879(2003).
Gough et al., "Assignment of homology to genome sequences using a library of hidden Markov models that represent all proteins of known structure," JMB, 313:903-19 (2000).
International Preliminary Report on Patentability, PCT/US2014/063572, dated May 3, 2016, 9 pages.
International Search Report and Written Opinion, PCT/US2014/063572, dated Apr. 3, 2015, 14 pages.
Iwao, Y. et al., "Changes of net charge and alpha-helical content affect the pharmacokinetic properties of human serum albumin," B.B.A Proteins and Proteomics, 1774: 1582-1590 (2007).
Jones, "GenTHREADER: an efficient and reliable protein fold recognition method for genomic sequences<http://www.sciencedirect.com/science/article/pii/S0022283699925834>," JMB, 287:797-815 (1999).
Kratz, F. et al., "Albumin as a drug carrier: Design of prodrugs, drug conjugates and Nanoparticles," Journal of Controlled Release, Elsevier, Amsterdam, NL, vol. 132 (3):171-183 (2008).
Larkin, M.A. et al., "Clustal W and Clustal X version 2.0," Bioinformatics, vol. 23(21):2947-2948 (2007).
Li, C. et al., "Preparation, structural analysis and bioactivity of ribonuclease A-albumin conjugate: Tetra-conjugation or PEG as the linker", Journal of Biotechnology, vol. 162(2-3): 283-288 (2012).
Lindahl et al., "Identification of related proteins on family, superfamily and fold level<http://www.sciencedirect.com/science/article/pii/S0022283699933776>," JMB, 295:613-15 (2000).
Marinaro, J. et al., "O-glycosylation delays the clearance of human IGF-binding protein-6 from the circulation," European Journal of Endocrinology, 142:512-516 (2000).
Mathsson, L. et al., "Cytokine induction by circulating immune complexes and signs of in-vivo complement activation in systemic lupus erythematosus are associated with the occurrence of anti-Sjogren's syndrome A antibodies," Clin Expt Immunol, 147:513-520 (2007).
Mcguffin, L. et al., "Improvement of the GenTHREADER method for genomic fold recognition," Bioinformatics,19:874-881 (2003).
Minchiotti et al., "Structural characterization of two genetic variants of human serum albumin," Biochem Biophys Acta, 916:411-418(1987).
Needleman et al., "A general method applicable to the search for similarities in the amino acid sequence of two proteins," J Mol Biol, 48:44-453(1970).
Ohtsuka, E. et al., "An alternative approach to deoxyoligonucleotides as hybridization probes by insertion of deoxyinosine at ambiguous codon positions," JBC, 260(5):2605-2608 (1985).

(56) References Cited

OTHER PUBLICATIONS

Pan, C. et al., "Improved potency of hyperactive and actin-resistant human DNase I variants for treatment of cystic fibrosis and systemic lupus erythematosus," JBC, 273(29):18374-18381 (1998).
Peach et al., "Structural characterization of a glycoprotein variant of human serum albumin," Biochim Biophys Acta, 1097:49-54 (1991).
Pearson, W. et al., "Improved tools for biological sequence comparison," PNAS, 85:2444-2448 (1988).
Rice et al., "Emboss: the European Molecular Biology Open Software Suite," Trends Genet, 16:276-7 (2000).
Rodriguez et al., "Identification, localization, and expression of two novel human genes similar to deoxyribonuclease I," Genomics, 42:507-13 (1997).
Roth et al., "Identification and Quantification of Protein Glycosylation," International Journal of Carbohydrate Chemistry, 1-10 (2012).
Smith, T. et al., "Comparison of Biosequences," Adv Appl Math, 2:482-489 (1981).
Sojar, H. et al., "Characterization of rat ovarian lutropin receptor," JBC, 264(5):2552-2559 (1989).
Stahl, P. et al., "Evidence for specific recognition sites mediating clearance of lysosomal enzymes in vivo," PNAS, 73 (11):4045-4049 (1976).
Takahashi, N. et al., "Amino acid substitutions in genetic variants of human serum albumin and in sequences inferred from molecular cloning," PNAS, 84:4413-4417 (1987).
Thorpe, P. et al., "Modification of the carbohydrate in ricin with metaperiodate-cyanoborohydride mixtures. Effects on toxicity and in vivo distribution," Eur J Biochem, 147: 197-206 (1985).
Weenen, C. et al., "Long-acting follicle-stimulating hormone analogs containing n-linked glycosylation exhibited increased bioactivity compared with o-linked analogs in female rats," J. Clin Endocrinol Metab, 89(10):5204-5212 (2004).
Yasuda et al., "A biochemical and genetic study on all non-synonymous single nucleotide polymorphisms of the gene encoding human deoxyribonuclease I potentially relevant to autoimmunity," Int J Biochem Cell Biol, 42:1216-25 (2010).
Zachara, N. et al., "Detection and analysis of proteins modified by o-linked n-acetylglucosamine," Curr Protoc Mol Biol., Unit 17.6 (2011).
Zheng et al., "Cloning and Characterization of a Novel Human DNase," BBRC, 231:499-504 (1997).
Achord et al., "Human beta-glucuronidase. II. Fate of infused human placental beta-glucuronidase in the rat," Pediat. Res., vol. 11:816-822 (1977).
Whisstock, J.C. et al., "Prediction of Protein Function from Protein Sequence and Structure," Quarterly Reviews of Biophysics, Cambridge University Press, vol. 36, No. 3:307-340 (2003).
Zhao, W-P. et al., "Relationship Between RNA Released from Mouse Apoptotic Murine Splenocytes and Autoimmune Disease," Chinese Journal of Biochemistry and Molecular Biology, vol. 19, No. 5:662-666 (2003) (with English abstract).
U.S. Appl. No. 15/679,746, filed Aug. 17, 2017, Jeffrey A. Ledbetter.
U.S. Appl. No. 13/822,215, Sep. 26, 2018, C. Dahle.
U.S. Appl. No. 13/822,215, Feb. 28, 2018, C. Dahle.
U.S. Appl. No. 13/822,215, Jul. 21, 2017, C. Dahle.
U.S. Appl. No. 14/516,161, May 19, 2017, C. Dahle.
U.S. Appl. No. 14/516,161, Jan. 26, 2017, C. Dahle.
U.S. Appl. No. 14/599,567, May 23, 2018, C. Dahle.
U.S. Appl. No. 14/599,567, Feb. 15, 2018, C. Dahle.
U.S. Appl. No. 14/599,567, Jul. 21, 2017, C. Dahle.
Fujihara, J. et al., "Two N-linked glycosylation sites (Asn18 and Asn106) are both required for full enzymatic activity, thermal stability, and resistance to proteolysis in mammalian deoxyribonuclease I.," Biosci Biotechnol Biochem, vol. 72(12) 3197-3205 (2008).
Autoimmune Disorders Medline Plus, National Institute of Health/US National Library of Medicine Review Date May 21, 2017, last updated Feb. 7, 2018, 4 pages.
A study of RSLV-132 in Subjects with Primary Sjogren's Syndrome, US National Library of Medicine, Feb. 23, 2018.
Burge et al. "Safety, pharmacokinetics, and pharmacodynamics of RSLV-132, an RNase-Fc fusion protein in systemic lupus erythematosus: a randomized, double-blind, placebo-controlled study," Lupus, vol. 26(8):825-834 (Jul. 2017).
Definition of Antibody-dependent cell-mediated cytotoxicity (ADDC). Dictionary pf Biology, 1st Ed. p. 434 (2010)—2 pages submitted.
Mathew, et al., "Humanized immunotoxins:A new generation of immunotoxins for targeted cancer therapy," Cancer Sci., vol. 100(8): 1359-1365 (Aug. 2009).
Rutkoski, T.J. and Raines, R.T., Curr. Pharm. Biotechnol., vol. 9:185-199 (2008).
Tew, M.B. et al., Arthritis and Reumatism, vol. 44(10):2446-2447 (2001).
International Preliminary Report on Patentability, PCT/US10/55131, dated May 8, 2012, 9 pages.
International Preliminary Report on Patentability, PCT/US12/35614, dated Sep. 4, 2012, 8 pages.
U.S. Appl. No. 16/229,431, filed Dec. 21, 2018, Jeffrey A. Ledbetter.
U.S. Appl. No. 15/679,746, Jul. 21, 2020, C. Dahle.
U.S. Appl. No. 15/679,746, Jan. 23, 2020, C. Dahle.
U.S. Appl. No. 15/679,746, May 21, 2019, C. Dahle.
U.S. Appl. No. 16/229,431, Feb. 24, 2020, C. Dahle.
U.S. Appl. No. 16/229,431, Jun. 18, 2019, C. Dahle.

* cited by examiner

THERAPEUTIC NUCLEASE-ALBUMIN FUSIONS AND METHODS

RELATED APPLICATIONS

This application is a 35 U.S.C. § 371 national stage filing of PCT Application No. PCT/US2014/063572 filed on Oct. 31, 2014, which claims the benefit of U.S. Provisional Patent Application Ser. No. 61/898,370, filed Oct. 31, 2013, U.S. Provisional Patent Application Ser. No. 61/898,384, filed Oct. 31, 2013, and U.S. Provisional Patent Application Ser. No. 61/898,393 filed Oct. 31, 2013. The entire content of each of the above-referenced patent applications is incorporated herein by this reference.

SEQUENCE LISTING

The instant application contains a Sequence Listing which has been submitted electronically in ASCII format and is hereby incorporated by reference in its entirety. Said ASCII copy, created Apr. 27, 2016, is name 2016-04-27_RSN-012US_ST25.txt and is 748,947 bytes in size.

BACKGROUND

Excessive release of (ribo)nucleoprotein particles from dead and dying cells can cause lupus pathology by two mechanisms: (i) Deposition or in situ formation of chromatin/anti-chromatin complexes causes nephritis and leads to loss of renal function; and (ii) nucleoproteins activate innate immunity through toll-like receptor (TLR) 3, 7, 8, and 9 as well as TLR-independent pathway(s). Release of nucleoproteins can serve as a potent antigen for autoantibodies in SLE, providing amplification of B cell and DC activation through co-engagement of antigen receptors and TLRs. Thus, there exists a need for a means to remove inciting antigens and/or attenuate immune stimulation, immune amplification, and immune complex mediated disease in subjects in need thereof, for example, with long-acting nuclease molecules that attack circulating immune complexes by digesting nucleic acids contained therein.

SUMMARY OF THE INVENTION

The invention relates, in part, to a hybrid nuclease-albumin molecule comprising a first nuclease domain and an albumin, or a variant or fragment thereof, wherein the first nuclease domain is operably coupled to the albumin, or variant or fragment thereof (i.e., hybrid nuclease-albumin molecules), and exhibits enhanced pharmacokinetic activity relative to the first nuclease domain alone. Such hybrid nuclease-albumin molecules exhibit altered (e.g., improved) serum half-life relative to the first nuclease domain alone through, e.g., increased interactions with the neonatal Fc receptor (FcRn), and have reduced toxicity relative to nuclease domains having, for example, an Fc domain, given the lack of effector Fc receptor activation.

In some embodiments, the hybrid nuclease-albumin molecule is a polypeptide comprising an amino acid sequence of a nuclease domain and an amino acid sequence of an albumin (or variant or fragment thereof). In some embodiments, the molecule further includes a first linker domain, and the first nuclease domain is operably coupled to the albumin, or a variant or fragment thereof, via the first linker domain.

In some embodiments, the first nuclease domain is an RNase or DNase, for example, human RNase1 and human DNase1, respectively.

In some embodiments, the hybrid nuclease-albumin molecule further includes a second nuclease domain (e.g., an RNase or DNase domain), which is operably coupled to the first nuclease domain or the N- or C-terminus of albumin, or a variant or fragment thereof, optionally via a linker. In some embodiments, the first and second nuclease domains are the same, e.g., RNase and RNase, or DNase and DNase. In other embodiments, the first and second nuclease domains are different, e.g., RNase and DNase.

In some embodiments, the RNase domain is a wild-type RNase, such as wild-type human RNase1 (SEQ ID NO: 75 or 76). In other embodiments, the RNase domain is a mutant RNase, such as an aglycosylated, underglycosylated, or deglycosylated RNase1, such as human RNase1 N34S/N76S/N88S (SEQ ID NO: 84). In some embodiments, the RNase containing hybrid nuclease-albumin molecule degrades circulating RNA and RNA in immune complexes, or inhibits interferon-alpha production, or both. In yet other embodiments, the activity of the RNase is not less than about 10-fold less, such as 9-fold less, 8-fold less, 7-fold less, 6-fold less, 5-fold less, 4-fold less, 3-fold less, or 2-fold less than the activity of a control RNase molecule. In yet other embodiments, the activity of the RNase is about equal to the activity of a control RNase molecule.

In some embodiments, the DNase domain is wild type DNase, such as wild type, human DNase1 (SEQ ID NO: 66 or 67). In other embodiments, the DNase domain is a mutant DNase domain, such as mutant, human DNase1 A114F (SEQ ID NO: 68) or an aglycosylated, underglycosylated, or deglycosylated human DNase, such as mutant, human DNase1 N18S/N106S/A114F (SEQ ID NO: 83). In some embodiments, the DNase domain is mutant human DNase1 E13R/N74K/A114F/T205K (SEQ ID NO:108). In other embodiments, the DNase domain is mutant human DNase1 E13R/N74K/A114F/T205K/N18S/N106S (SEQ ID NO:109).

In some embodiments, the DNase containing hybrid nuclease-albumin molecule degrades circulating DNA and DNA in immune complexes, or inhibits interferon-alpha production, or both. In yet other embodiments, the activity of the DNase is not less than about 10-fold less, such as 9-fold less, 8-fold less, 7-fold less, 6-fold less, 5-fold less, 4-fold less, 3-fold less, or 2-fold less than the activity of a control DNase molecule. In yet other embodiments, the activity of the DNase is about equal to the activity of a control DNase molecule.

In some embodiments, the hybrid nuclease-albumin molecule has a gly-ser linker (e.g., $(Gly_4Ser)_3$ (SEQ ID NO: 85)) separating the first and second nuclease domains, and/or the nuclease domains from the albumin, or a variant or fragment thereof.

In some embodiments, the hybrid nuclease-albumin molecule has an increased serum half-life and/or activity relative to the corresponding nuclease domain that is not fused to the albumin, or variant or fragment thereof.

In some embodiments, the albumin, a variant or fragment thereof, is from human, primate (such as chimpanzee), gorilla or macaque, rodent (such as hamster, mouse, or rat), guinea pig, bovine (such as cow), equine (such as horse or donkey), rabbit, goat, sheep, dog, chicken and pig. Preferably, the albumin is human serum albumin (HSA). In some embodiments, the albumin variant is more than 80%, such as greater than 85%, greater than 90%, or greater than 95% identical to the amino acid sequence of HSA (SEQ ID NO: 1). In some embodiments, the albumin is a fragment of albumin or a variant thereof.

In some embodiments, the fragment is at least 20 amino acids, such as at least 40 amino acids, at least 60 amino acids, at least 80 amino acids, at least 100 amino acids, at least 150 amino acids, at least 200 amino acids, at least 300 amino acids, at least 400 amino acids, or at least 500 amino acids in length.

In some aspects, the hybrid nuclease-albumin molecule includes the mutant, human DNase1 A114F domain set forth in (SEQ ID NO: 68). In another embodiment, the hybrid nuclease-albumin molecule includes the mutant, human DNase1 N18S/N106S/A114F domain set forth in SEQ ID NO: 83. In another embodiment, the hybrid nuclease-albumin molecule includes the human, wild-type RNase1 domain set forth in SEQ ID NO: 75. In another embodiment, the hybrid nuclease-albumin molecule includes the human, mutant RNase1 N34S/N76S/N88S domain set forth in SEQ ID NO: 84. In another embodiment, the hybrid nuclease-albumin molecule includes HSA set forth in SEQ ID NO: 1. In another embodiment, the hybrid nuclease-albumin molecule includes the $(Gly_4Ser)_3$ linker domain set forth in SEQ ID NO: 85. In another embodiment, the hybrid nuclease-albumin molecule includes a VK3LP leader (SEQ ID NO: 86). These individual domains can be operably coupled to each other in any order to form a hybrid nuclease-albumin molecule that is enzymatically active.

In some aspects, the invention provides hybrid nuclease-albumin molecules having the amino acid sequences set forth in SEQ ID NOs: 18-65, 110-125, and 138-139. In other aspects, the hybrid nuclease-albumin molecules have amino acid sequences at least 90% identical to the amino acid sequences set forth in SEQ ID NOs: 18-65, 110-125, and 138-139.

In some aspects, the invention provides compositions including the hybrid nuclease-albumin molecules and a carrier, such as a pharmaceutically acceptable carrier or diluent.

In some aspects, the invention provides nucleic acid molecules that encode the hybrid nuclease-albumin molecules disclosed herein. In some embodiments, the invention provides a recombinant expression vector having a nucleic acid molecule that encodes the hybrid nuclease-albumin molecules disclosed herein. In some embodiments, the invention provides host cells transformed with the recombinant expression vectors containing the nucleic acid sequences encoding the hybrid nuclease-albumin molecules disclosed herein. Also disclosed herein is a method of making a hybrid nuclease-albumin molecule disclosed herein involving providing a host cell comprising a nucleic acid sequence that encodes the hybrid nuclease-albumin molecule; and maintaining the host cell under conditions in which the hybrid nuclease-albumin molecule is expressed.

Also disclosed herein is a method for treating or preventing a condition associated with an abnormal immune response by administering to a patient in need thereof an effective amount of an isolated hybrid nuclease-albumin molecule disclosed herein. In some embodiments, the condition is an autoimmune disease. In some embodiments, the autoimmune disease is selected from the group consisting of insulin-dependent diabetes mellitus, multiple sclerosis, experimental autoimmune encephalomyelitis, rheumatoid arthritis, experimental autoimmune arthritis, myasthenia gravis, thyroiditis, an experimental form of uveoretinitis, Hashimoto's thyroiditis, primary myxoedema, thyrotoxicosis, pernicious anaemia, autoimmune atrophic gastritis, Addison's disease, premature menopause, male infertility, juvenile diabetes, Goodpasture's syndrome, pemphigus vulgaris, pemphigoid, sympathetic ophthalmia, phacogenic uveitis, autoimmune haemolytic anaemia, idiopathic leucopenia, primary biliary cirrhosis, active chronic hepatitis Hbs-ve, cryptogenic cirrhosis, ulcerative colitis, Sjogren's syndrome, scleroderma, Wegener's granulomatosis, polymyositis, dermatomyositis, discoid LE, systemic lupus erythematosus (SLE), and connective tissue disease. In some embodiments, the autoimmune disease is SLE or Sjogren's syndrome.

Also disclosed herein is a method of treating SLE or Sjogren's syndrome comprising administering to a subject a hybrid nuclease-albumin molecule containing composition in an amount effective to degrade immune complexes containing RNA, DNA or both RNA and DNA. In some aspects, the composition includes a pharmaceutically acceptable carrier and a hybrid nuclease-albumin molecule as described herein. In other aspects, the composition includes a hybrid nuclease-albumin molecule comprising a polypeptide having an amino acid sequence set forth in SEQ ID NO: 18-65, 110-125, and 138-139.

In another aspect, the invention relates to hybrid nuclease-albumin molecules for use in treating diseases characterized by defective clearance or processing of apoptotic cells and cell debris, such as SLE. In some embodiments, the hybrid nuclease-albumin molecule is a polypeptide comprising an amino acid sequence set forth in SEQ ID NOs: 18-65, 110-125, and 138-139.

In another aspect, the invention relates to the use of the hybrid nuclease-albumin molecules for manufacturing a medicament for treating diseases characterized by defective clearance or processing of apoptotic cells and cell debris, such as SLE. In some embodiments, the hybrid nuclease-albumin molecule is a polypeptide comprising an amino acid sequence set forth in SEQ ID NOs: 18-65, 110-125, and 138-139.

BRIEF DESCRIPTION OF THE DRAWINGS

These and other features, aspects, and advantages of the present invention will become better understood with regard to the following description, and accompanying drawing, where.

DETAILED DESCRIPTION

Overview

Figure 1A:
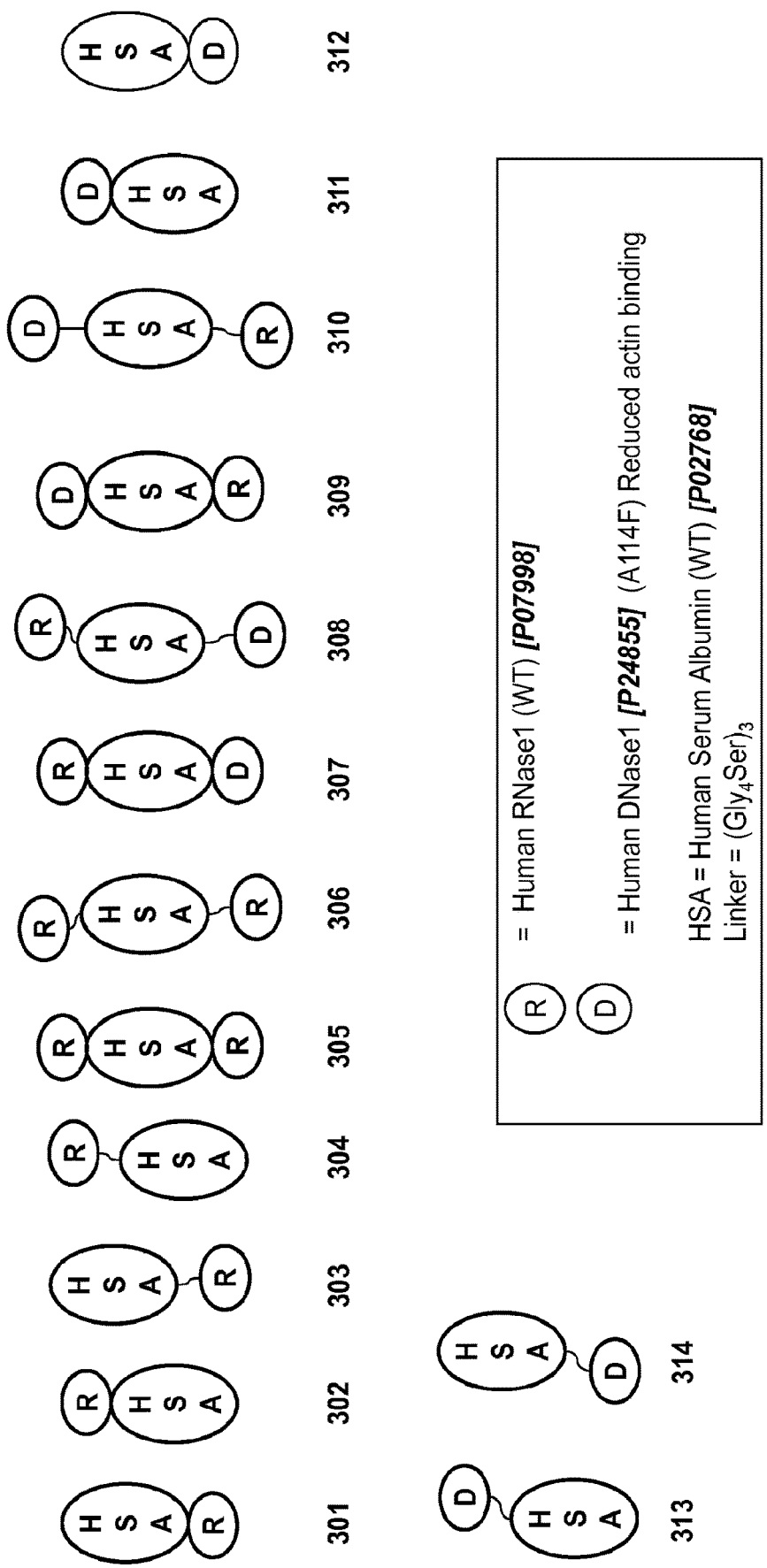
FIGS. 1A-C is a schematic depicting the various configurations of the RSVL-300 hybrid nuclease-albumin fusions described herein. RSLV-329 has an NLG linker connecting DNase to the HSA.

Systemic lupus erythematosus (SLE) is a multisystem autoimmune disease characterized by the presence of high titer autoantibodies directed against self nucleoprotein particles. There is strong evidence that defective clearance or processing of dead and dying cells in SLE leads to disease, predominantly through exposure of ribo- and deoxy-ribo-nucleoprotein particles (abbreviated nucleoproteins). The nucleoproteins cause damage through three mechanisms: i) serve as antigens to generate circulating high affinity autoantibodies; ii) activation of the innate immune system to produce inflammatory cytokines as a result of immune complex formation; and iii) mediate organ dysfunction as a result of the deposition of immune complexes at local sites such as the kidney.

The present invention provides methods for treating diseases characterized by defective clearance or processing of apoptotic cells and cell debris, such as SLE and Sjogren's syndrome, by administering an effective amount of a nuclease activity to degrade extracellular RNA and DNA containing immune complexes. Such treatment can inhibit production of Type I interferons (IFNs) which are prominent cytokines in SLE and are strongly correlated with disease activity and nephritis.

The present invention relates, in part, to the provision of such enzymatically active nucleases. In particular, the invention relates to nucleases that are operably coupled to albumin, or a variant or fragment thereof. Albumin is an abundant aglycosylated protein produced in the liver that regulates the osmotic pressure of blood, and acts as a carrier for various substances in the blood stream. Wild-type albumin has a long serum half-life (about 19 days), which in part can be attributed to binding to the neonatal Fc receptor (FcRn). Accordingly, when operably coupled to one or more nucleases, the resulting hybrid nuclease-albumin molecules exhibit altered serum half-life. Another advantage conferred by albumin is that it does not activate effector Fc receptors, and thus the hybrid nuclease-albumin molecules may avoid toxicity associated with activating these receptors.

Accordingly, in one embodiment, a subject with a disease characterized by defective clearance or processing of apoptotic cells and cell debris is treated by administering a hybrid nuclease-albumin molecule, which includes one or more nuclease domains (e.g., a DNase, RNase or combination) coupled to an albumin, or a variant or fragment thereof that retains albumin activity, such that the hybrid nuclease-albumin molecule has increased bioavailability and/or serum half-life relative to the non-conjugated nuclease domain. In one aspect, a hybrid nuclease-albumin molecule includes first and second nuclease domains.

In another aspect, a method of treating SLE or Sjogren's syndrome is provided in which a sufficient or effective amount of a nuclease-albumin molecule-containing composition is administered to a subject. In one aspect, treatment results in degradation of immune complexes containing RNA, DNA or both RNA and DNA. In another aspect, treatment results in inhibition of Type I interferons, such as interferon-α, in a subject. In one aspect, a method of treating a subject comprises administering an effective amount of a composition of a hybrid nuclease-albumin molecule comprising a polypeptide having an amino acid sequence set forth in SEQ ID NOs: 18-65, 110-125, and 138-139.

In another aspect, the invention relates to hybrid nuclease-albumin molecules for use in treating diseases characterized by defective clearance or processing of apoptotic cells and cell debris, such as SLE. In some embodiments, the hybrid nuclease-albumin molecule comprises a polypeptide comprising an amino acid sequence set forth in SEQ ID NOs: 18-65, 110-125, and 138-139.

In another aspect, the invention relates to the use of the hybrid nuclease-albumin molecules for manufacturing a medicament for treating diseases characterized by defective clearance or processing of apoptotic cells and cell debris, such as SLE. In some embodiments, the hybrid nuclease-albumin molecule comprises a polypeptide comprising an amino acid sequence are those set forth in SEQ ID NOs: 18-65, 110-125, and 138-139.

Definitions

Terms used in the claims and specification are defined as set forth below unless otherwise specified.

"Amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refer to chemical compounds that have a structure that is different from the general chemical structure of an amino acid, but that function in a manner similar to a naturally occurring amino acid.

Amino acids can be referred to herein by either their commonly known three letter symbols or by the one-letter symbols recommended by the IUPAC-IUB Biochemical Nomenclature Commission. Nucleotides, likewise, can be referred to by their commonly accepted single-letter codes.

An "amino acid substitution" refers to the replacement of at least one existing amino acid residue in a predetermined amino acid sequence (an amino acid sequence of a starting polypeptide) with a second, different "replacement" amino acid residue. An "amino acid insertion" refers to the incorporation of at least one additional amino acid into a predetermined amino acid sequence. While the insertion will usually consist of the insertion of one or two amino acid residues, larger "peptide insertions" can be made, e.g. insertion of about three to about five or even up to about ten, fifteen, or twenty amino acid residues. The inserted residue(s) may be naturally occurring or non-naturally occurring as disclosed above. An "amino acid deletion" refers to the removal of at least one amino acid residue from a predetermined amino acid sequence.

"Polypeptide," "peptide," and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymer.

"Nucleic acid" refers to deoxyribonucleotides or ribonucleotides and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences, as well as the sequence explicitly indicated. Specifically, degenerate codon substitutions can be achieved by generating sequences in which the third position of one or more selected (or all) codons is substituted with mixed-base and/or deoxyinosine residues (Batzer et al., *Nucleic Acid Res* 1991; 19:5081; Ohtsuka et al., *JBC* 1985; 260: 2605-8); Rossolini et al., *Mol Cell Probes* 1994; 8:91-8). For arginine and leucine, modifications at the second base can also be conservative. The term nucleic acid is used interchangeably with gene, cDNA, and mRNA encoded by a gene.

Polynucleotides of the present invention can be composed of any polyribonucleotide or polydeoxribonucleotide, which can be unmodified RNA or DNA or modified RNA or DNA. For example, polynucleotides can be composed of single- and double-stranded DNA, DNA that is a mixture of single- and double-stranded regions, single- and double-stranded RNA, and RNA that is a mixture of single- and double-stranded regions, hybrid molecules comprising DNA and RNA that can be single-stranded or, more typically, double-stranded or a mixture of single- and double-stranded regions. In addition, the polynucleotide can be composed of triple-stranded regions comprising RNA or DNA or both RNA and DNA. A polynucleotide can also contain one or more modified bases or DNA or RNA backbones modified for stability or for other reasons. "Modified" bases include, for example, tritylated bases and unusual bases such as inosine. A variety of modifications can be made to DNA and RNA; thus, "polynucleotide" embraces chemically, enzymatically, or metabolically modified forms.

As used herein, the term "operably linked" or "operably coupled" refers to a juxtaposition wherein the components described are in a relationship permitting them to function in their intended manner.

As used herein, the term "hybrid nuclease-albumin molecule" refers to polynucleotides or polypeptides that comprise at least one nuclease domain and an albumin, or a variant or fragment thereof. Hybrid nuclease-albumin molecules are also referred to as fusion protein(s) and fusion gene(s). For example, in one embodiment, a hybrid nuclease-albumin molecule can be a polypeptide comprising an albumin, or a variant or fragment thereof, operably coupled to a nuclease domain such as DNase and/or RNase. As another example, a hybrid nuclease-albumin molecule can include an RNase nuclease domain, a linker domain, and an albumin, or a variant or fragment thereof. SEQ ID NOs: 18-65, 110-125, and 138-139 are examples of hybrid nuclease-albumin molecules. Other examples are described in more detail below. In one embodiment a hybrid nuclease-albumin molecule of the invention can have altered glycosylation or include additional modifications. In another embodiment, a hybrid nuclease-albumin molecule may be modified to add a functional moiety (e.g., a drug or label).

The term "albumin" refers to a protein having the same, or very similar three dimensional structure as human albumin (SEQ ID NO: 100) and having a long serum half-life. Exemplary albumin proteins include human serum albumin (HSA; SEQ ID NO: 1), primate serum albumin (such as chimpanzee serum albumin (SEQ ID NO: 2)), gorilla serum albumin or macaque serum albumin (SEQ ID NO: 3), rodent serum albumin (such as hamster serum albumin (SEQ ID NO: 4)), guinea pig serum albumin (SEQ ID NO: 5), mouse serum albumin (SEQ ID NO: 6) and rat serum albumin (SEQ ID NO: 7), bovine serum albumin (such as cow serum albumin (SEQ ID NO: 8)), equine serum albumin (such as horse serum albumin (SEQ ID NO: 9) or donkey serum albumin (SEQ ID NO: 10)), rabbit serum albumin (SEQ ID NO: 11), goat serum albumin (SEQ ID NO: 12), sheep serum albumin (SEQ ID NO: 13), dog serum albumin (SEQ ID NO: 14), chicken serum albumin (SEQ ID NO: 15) and pig serum albumin (SEQ ID NO: 16).

The term "albumin activity" refers to the ability of an albumin, or a variant or fragment thereof, to prolong the half-life of a hybrid nuclease-albumin molecule compared to a nuclease not fused to albumin. Albumin activity may also refer to the ability of the albumin, or a variant or fragment thereof, to bind to the neonatal Fc receptor (FcRn) receptor, e.g., human FcRn (SEQ ID NO: 17).

The term "wild-type" (WT) albumin means albumin having the same amino acid sequence as naturally found in an animal or in a human being. In one embodiment, the wild type albumin is HSA (SEQ ID NO: 1).

The term "variant," when used in the context of albumin, refers to a polypeptide derived from a wild-type albumin and differs from the wild-type albumin by one or more alteration(s), i.e., a substitution, insertion, and/or deletion, at one or more positions. A substitution means a replacement of an amino acid occupying a position with a different amino acid. A deletion means removal of an amino acid occupying a position. An insertion means adding 1 or more, such as 1-3 amino acids, immediately adjacent to an amino acid occupying a position. Variant albumins necessarily have less than 100% sequence identity or similarity with the wild-type albumin. In a preferred embodiment, the variant albumin will have an amino acid sequence from about 75% to less than 100% amino acid sequence identity or similarity with the amino acid sequence of the wild-type albumin, more preferably from about 80% to less than 100%, more preferably from about 85% to less than 100%, more preferably from about 90% to less than 100% (e.g., 91%, 92%, 93%, 94%, 95%, 96%, 97%, 98% o, 99%) and most preferably from about 95% to less than 100%, e.g., over the length of the variant molecule.

For purposes of the present invention, the polypeptide of HSA set forth in SEQ ID NO: 1 is used to determine the corresponding amino acid residue in another albumin, e.g., an albumin variant or natural albumin variant. The amino acid sequence of another albumin is aligned with the mature polypeptide set forth in SEQ ID NO: 1, and based on the alignment, the amino acid position number corresponding to any amino acid residue in the mature polypeptide set forth in SEQ ID NO: 1 is determined using the Needleman-Wunsch algorithm (Needleman and Wunsch, JMB 1970; 48:443-53) as implemented in the Needle program of the EMBOSS package (EMBOSS: The European Molecular Biology Open Software Suite, Rice et al., Trends Genet 2000; 16:276-7), preferably version 3.0.0 or later. Identification of the corresponding amino acid residue in another albumin can be confirmed by an alignment of multiple polypeptide sequences using "ClustalW" (Larkin et al., Bioinformatics 2007; 23:2947-8). When the other polypeptide (or protein) has diverged from the mature polypeptide set forth in SEQ ID NO: 1 such that traditional sequence-based comparison fails to detect their relationship (Lindahl and Elofsson, JMB 2000; 295:613-15), other pairwise sequence comparison algorithms can be used. Greater sensitivity in sequence-based searching can be attained using search programs that utilize probabilistic representations of polypeptide families (profiles) to search databases. For example, the PSI-BLAST program generates profiles through an iterative database search process and is capable of detecting remote homologs (Atschul et al., Nucleic Acids Res 1997; 25:3389-402). Even greater sensitivity can be achieved if the family or superfamily for the polypeptide has one or more representatives in the protein structure databases. Programs such as GenTHREADER (Jones, JMB 1999; 287:797-81 5; McGuffin and Jones, Bioinformatics 2003; 19:874-81) utilize information from a variety of sources (PSI-BLAST, secondary structure prediction, structural alignment profiles, and solvation potentials) as inputs to a neural network that predicts the structural fold for a query sequence. Similarly, the method of Gough et al., JMB 2000; 313:903-19, can be used to align a sequence of unknown structure within the superfamily models present in the SCOP database. These alignments can in turn be used to generate homology models for the polypeptide, and such models can be assessed for accuracy using a variety of tools developed for that purpose.

The term "fragment," when used in the context of albumin, refers to any fragment of full-length albumin or a variant thereof that extends the half-life of a nuclease domain to which it is fused or conjugated relative to the corresponding non-fused nuclease domain. A fragment of an albumin may be referred to as a "portion," "region," or "moiety." In some embodiments, a fragment of an albumin can refer to a polypeptide comprising a fusion of multiple domains of albumin (see, e.g., WO 2011/124718), such as domains I and III, and domains II and III, as described in more detail infra.

As used herein, the term "serum half-life" refers to the time required for the in vivo serum hybrid nuclease-albumin molecule concentration to decline by 50%. The shorter the serum half-life of the hybrid nuclease-albumin molecule, the shorter time it will have to exert a therapeutic effect, although in some embodiments as discussed infra, a shorter serum half-life of the hybrid nuclease-albumin molecule is desirable. A "longer serum half-life" and similar expressions are understood to be in relationship to the corresponding wild-type albumin molecule (e.g., HSA with the amino acid sequence of SEQ ID NO: 1). Thus, a variant with longer serum half-life means that the variant has a longer serum half-life than the corresponding wild-type albumin.

As used herein, the term "glycosylation" or "glycosylated" refers to a process or result of adding sugar moieties to a molecule (e.g., a hybrid nuclease-albumin molecule).

As used herein, the term "altered glycosylation" refers to a molecule that is aglycosylated, deglycosylated, or underglycosylated.

As used herein, "glycosylation site(s)" refers to both sites that potentially could accept a carbohydrate moiety, as well as sites within the protein on which a carbohydrate moiety has actually been attached and includes any amino acid sequence that could act as an acceptor for an oligosaccharide and/or carbohydrate.

As used herein, the term "aglycosylation" or "aglycosylated" refers to the production of a molecule (e.g., a hybrid nuclease-albumin molecule) in an unglycosylated form (e.g., by engineering a hybrid nuclease-albumin molecule to lack amino acid residues that serve as acceptors of glycosylation). Alternatively, the hybrid nuclease-albumin molecule can be expressed in, e.g., E. coli, to produce an aglycosylated hybrid nuclease-albumin molecule.

As used herein, the term "deglycosylation" or "deglycosylated" refers to the process or result of enzymatic removal of sugar moieties on a molecule.

As used herein, the term "underglycosylation" or "underglycosylated" refers to a molecule in which one or more carbohydrate structures that would normally be present if produced in a mammalian cell has been omitted, removed, modified, or masked.

In certain aspects, the hybrid nuclease-albumin molecules of the invention can employ one or more "linker domains," such as polypeptide linkers. As used herein, the term "linker domain" refers to a sequence which connects two or more domains in a linear sequence. As used herein, the term "polypeptide linker" refers to a peptide or polypeptide sequence (e.g., a synthetic peptide or polypeptide sequence) which connects two or more domains in a linear amino acid sequence of a polypeptide chain. For example, polypeptide linkers may be used to connect a nuclease domain to an albumin, or a variant or fragment thereof. Preferably, such polypeptide linkers can provide flexibility to the polypeptide molecule. In certain embodiments the polypeptide linker is used to connect (e.g., genetically fuse) an albumin, or a variant or fragment thereof, with one or more nuclease domains. A hybrid nuclease-albumin molecule of the invention may comprise more than one linker domain or peptide linker. Various peptide linkers are known in the art.

As used herein, the term "gly-ser polypeptide linker" refers to a peptide that consists of glycine and serine residues. An exemplary gly/ser polypeptide linker comprises the amino acid sequence $(Gly_4Ser)_n$. In some embodiments, n is 1 or more, such as 2 or more, 3 or more, 4 or more, 5 or more, 6 or more, 7 or more, 8 or more, 9 or more, or 10 or more (e.g., (Gly$_4$Ser)$_{10}$). Another exemplary gly/ser polypeptide linker comprises the amino acid sequence Ser (Gly$_4$Ser)$_n$. In some embodiments, n is 1 or more, such as 2 or more, 3 or more, 4 or more, 5 or more, 6 or more, 7 or more, 8 or more, 9 or more, or 10 or more (e.g., Ser(Gly$_4$Ser)$_{10}$).

As used herein, the terms "coupled," "linked," "fused," or "fusion," are used interchangeably. These terms refer to the joining together of two more elements or components or domains, by whatever means including chemical conjugation or recombinant means. Methods of chemical conjugation (e.g., using heterobifunctional crosslinking agents) are known in the art.

A polypeptide or amino acid sequence "derived from" a designated polypeptide or protein refers to the origin of the polypeptide. Preferably, the polypeptide or amino acid sequence which is derived from a particular sequence has an amino acid sequence that is essentially identical to that sequence or a portion thereof, wherein the portion consists of at least 10-20 amino acids, preferably at least 20-30 amino acids, more preferably at least 30-50 amino acids, or which is otherwise identifiable to one of ordinary skill in the art as having its origin in the sequence. Polypeptides derived from another peptide may have one or more mutations relative to the starting polypeptide, e.g., one or more amino acid residues which have been substituted with another amino acid residue or which has one or more amino acid residue insertions or deletions.

In one embodiment, there is one amino acid difference between a starting polypeptide sequence and the sequence derived therefrom. Identity or similarity with respect to this sequence is defined herein as the percentage of amino acid residues in the candidate sequence that are identical (i.e., same residue) with the starting amino acid residues, after aligning the sequences and introducing gaps, if necessary, to achieve the maximum percent sequence identity.

In one embodiment, a polypeptide of the invention consists of, consists essentially of, or comprises an amino acid sequence selected from Table 1 and functionally active variants thereof. In an embodiment, a polypeptide includes an amino acid sequence at least 80%, such as at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identical to an amino acid sequence set forth in Table 1. In some embodiments, a polypeptide includes a contiguous amino acid sequence at least 80%, such as at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identical to a contiguous amino acid sequence set forth in Table 1. In some embodiments, a polypeptide includes an amino acid sequence having at least 10, such as at least 15, at least 20, at least 25, at least 30, at least 35, at least 40, at least 45, at least 50, at least 55, at least 60, at least 65, at least 70, at least 75, at least 80, at least 85, at least 90, at least 95, at least 100, at least 200, at least 300, at least 400, or at least 500 (or any integer within these numbers) contiguous amino acids of an amino acid sequence set forth in Table 1.

In some embodiments, the peptides of the invention are encoded by a nucleotide sequence. Nucleotide sequences of the invention can be useful for a number of applications, including: cloning, gene therapy, protein expression and purification, mutation introduction, DNA vaccination of a host in need thereof, antibody generation for, e.g., passive immunization, PCR, primer and probe generation, siRNA design and generation (see, e.g., the Dharmacon siDesign website), and the like. In some embodiments, the nucleotide sequence of the invention comprises, consists of, or consists essentially of, a nucleotide sequence that encodes the amino acid sequence of the hybrid nuclease-albumin molecules selected from Table 1. In some embodiments, a nucleotide sequence includes a nucleotide sequence at least 80%, such as at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identical to a nucleotide sequence encoding the amino acid sequence of the hybrid nuclease-albumin molecules in Table 1. In some embodiments, a nucleotide sequence includes a contiguous nucleotide sequence at least 80%, such as at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identical to a contiguous nucleotide sequence encoding the amino acid sequences set forth in Table 1. In some embodiments, a nucleotide sequence includes a nucleotide sequence having at least 10, such as at least 15, such as at least 20, at least 25, at least 30, at least 35, at least 40, at least 45, at least 50, at least 55, at least 60, at least 65, at least 70, at least 75, at least 80, at least 85, at least 90, at least 95, at least 100, at least 200, at least 300, at least 400, or at least 500 (or any integer within these numbers) contiguous nucleotides of a nucleotide sequence encoding the amino acid sequences set forth in Table 1.

In some embodiments, polypeptide sequences of the invention are not immunogenic and/or have reduced immunogenicity.

It will also be understood by one of ordinary skill in the art that the hybrid nuclease-albumin molecules of the invention may be altered such that they vary in sequence from the naturally occurring or native sequences from which their components (e.g., nuclease domains, linker domains, and albumin domains) are derived, while retaining the desirable activity of the native sequences. For example, nucleotide or amino acid substitutions leading to conservative substitutions or changes at "non-essential" amino acid residues may be made. An isolated nucleic acid molecule encoding a non-natural variant of a hybrid nuclease-albumin molecule derived from an albumin (e.g., HSA) can be created by introducing one or more nucleotide substitutions, additions or deletions into the nucleotide sequence of the albumin such that one or more amino acid substitutions, additions or deletions are introduced into the encoded protein. Mutations may be introduced by standard techniques, such as site-directed mutagenesis and PCR-mediated mutagenesis.

The hybrid nuclease-albumin molecules of the invention may comprise conservative amino acid substitutions at one or more amino acid residues, e.g., at essential or non-essential amino acid residues. A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), and aromatic side chains (e.g., tyrosine, phenylalanine, tryptophan, histidine). Thus, a nonessential amino acid residue in a hybrid nuclease-albumin molecule is preferably replaced with another amino acid residue from the same side chain family. In another embodiment, a string of amino acids can be replaced with a structurally similar string that differs in order and/or composition of side chain family members. Alternatively, in another embodiment, mutations may be introduced randomly along all or part of a coding sequence, such as by saturation mutagenesis, and the resultant mutants can be incorporated into hybrid nuclease-albumin molecules of the invention and screened for their ability to bind to the desired target.

The term "ameliorating" refers to any therapeutically beneficial result in the treatment of a disease state, e.g., an autoimmune disease state (e.g., SLE, Sjogren's syndrome), including prophylaxis, lessening in the severity or progression, remission, or cure thereof.

The term "in situ" refers to processes that occur in a living cell growing separate from a living organism, e.g., growing in tissue culture.

The term "in vivo" refers to processes that occur in a living organism.

The term "mammal" or "subject" or "patient" as used herein includes both humans and non-humans and include but is not limited to humans, non-human primates, canines, felines, murines, bovines, equines, and porcines.

The term percent "identity," in the context of two or more nucleic acid or polypeptide sequences, refer to two or more sequences or subsequences that have a specified percentage of nucleotides or amino acid residues that are the same, when compared and aligned for maximum correspondence, as measured using one of the sequence comparison algorithms described below (e.g., BLASTP and BLASTN or other algorithms available to persons of skill) or by visual inspection. Depending on the application, the percent "identity" can exist over a region of the sequence being compared, e.g., over a functional domain, or, alternatively, exist over the full length of the two sequences to be compared.

For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, *Adv Appl Math* 1981; 2:482, by the homology alignment algorithm of Needleman & Wunsch, *J Mol Biol* 1970; 48:443, by the search for similarity method of Pearson & Lipman, *PNAS* 1988; 85:2444, by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al, infra).

One example of an algorithm that is suitable for determining percent sequence identity and sequence similarity is the BLAST algorithm, which is described in Altschul et al., *J Mol Biol* 1990; 215:403-10. Software for performing BLAST analyses is publicly available through the National Center for Biotechnology Information website.

The term "sufficient amount" means an amount sufficient to produce a desired effect, e.g., an amount sufficient to modulate protein aggregation in a cell.

The term "therapeutically effective amount" is an amount that is effective to ameliorate a symptom of a disease. A therapeutically effective amount can be a "prophylactically effective amount" as prophylaxis can be considered therapy.

The term "about" will be understood by persons of ordinary skill and will vary to some extent depending on the context in which it is used. If there are uses of the term which are not clear to persons of ordinary skill given the context in which it is used, "about" will mean up to plus or minus 10% of the particular value.

It must be noted that, as used in the specification and the appended claims, the singular forms "a," "an" and "the" include plural referents unless the context clearly dictates otherwise.

Hybrid Nuclease-Albumin Molecules

The hybrid nuclease-albumin molecules of the invention include an albumin, or a variant or fragment thereof, that alters the serum half-life of the nuclease molecules to which it is fused compared to nuclease molecules that are not fused to the albumin, or a variant or fragment thereof. Such hybrid nuclease-albumin molecules are referred to herein as "hybrid nuclease-albumin molecules" or "hybrid albumin-nuclease molecules," which are used interchangeably.

In some embodiments, a composition of the invention includes a hybrid nuclease-albumin molecule. In some embodiments, a hybrid nuclease-albumin molecule includes a nuclease domain operably coupled to an albumin, or a variant or fragment thereof. In some embodiments the hybrid nuclease-albumin molecule is a nuclease protein. In some embodiments, the hybrid nuclease-albumin molecule is a nuclease polynucleotide.

In some embodiments, the nuclease domain is operably coupled to the albumin, or a variant or fragment thereof, via a linker domain. In some embodiments, the linker domain is a linker peptide. In some embodiments, the linker domain is a linker nucleotide.

In some embodiments, the hybrid nuclease-albumin molecule includes a leader molecule, e.g., a leader peptide. In some embodiments, the leader molecule is a leader peptide positioned at the N-terminus of the nuclease domain. In some embodiments, a hybrid nuclease-albumin molecule of the invention comprises a leader peptide at the N-terminus of the molecule, wherein the leader peptide is later cleaved from the hybrid nuclease-albumin molecule. Methods for generating nucleic acid sequences encoding a leader peptide fused to a recombinant protein are well known in the art. In some embodiments, any of the hybrid nuclease-albumin molecule of the present invention can be expressed either with or without a leader fused to their N-terminus. The protein sequence of a hybrid nuclease-albumin molecule of the present invention following cleavage of a fused leader peptide can be predicted and/or deduced by one of skill in the art.

Examples of hybrid nuclease-albumin molecules of the present invention additionally including a VK3 leader peptide (VK3LP), wherein the leader peptide is fused to the N-terminus of the hybrid nuclease-albumin molecule, are set forth in SEQ ID NOs: 18-41 (RSLV-301, RSLV-302, RSLV-303, RSLV-304, RSLV-305, RSLV-306, RSLV-307, RSLV-308, RSLV-309, RSLV-310, RSLV-311, RSLV-312, RSLV-313, RSLV-314, RSLV-315, RSLV-316, RSLV-317, RSLV-318, RSLV-319, RSLV-320, RSLV-321, RSLV-322, RSLV-323, RSLV-324, RSLV-325, RSLV-326, RSLV-327, RSLV-328, RSLV-329, RSLV-330, RSLV-331 and RSLV-332, respectively). Such leader sequences can improve the level of synthesis and secretion of the hybrid nuclease-albumin molecules in mammalian cells. In some embodiments, the leader is cleaved, yielding hybrid nuclease-albumin molecules having the sequences set forth in SEQ ID NOs: 42-65 and 118-125. In some embodiments, a hybrid nuclease-albumin molecule of the present invention is expressed without a leader peptide fused to its N-terminus, and the resulting hybrid nuclease-albumin molecule has an N-terminal methionine.

In some embodiments, the hybrid nuclease-albumin molecule will include a stop codon. In some embodiments, the stop codon will be at the C-terminus of the albumin, or a variant or fragment thereof. In other embodiments, the stop codon will be at the C-terminus of the nuclease domain (e.g., RNase and/or DNase domain). Appropriate positioning of a stop codon will differ depending on the configuration of components within the hybrid nuclease-albumin molecule, and will be evident to the skilled artisan.

In some embodiments, the hybrid nuclease-albumin molecule further includes a second nuclease domain. In some embodiments, the second nuclease domain is operably coupled to the albumin, or variant or fragment thereof, via a second linker domain. In some embodiments, the second linker domain will be at the C-terminus of the albumin, or a variant or fragment thereof.

In some embodiments, the hybrid nuclease-albumin molecule includes two nuclease domains operably coupled to each other in tandem and further operably coupled to the N- or C-terminus of the albumin, or a variant or fragment thereof.

Figure 1B:
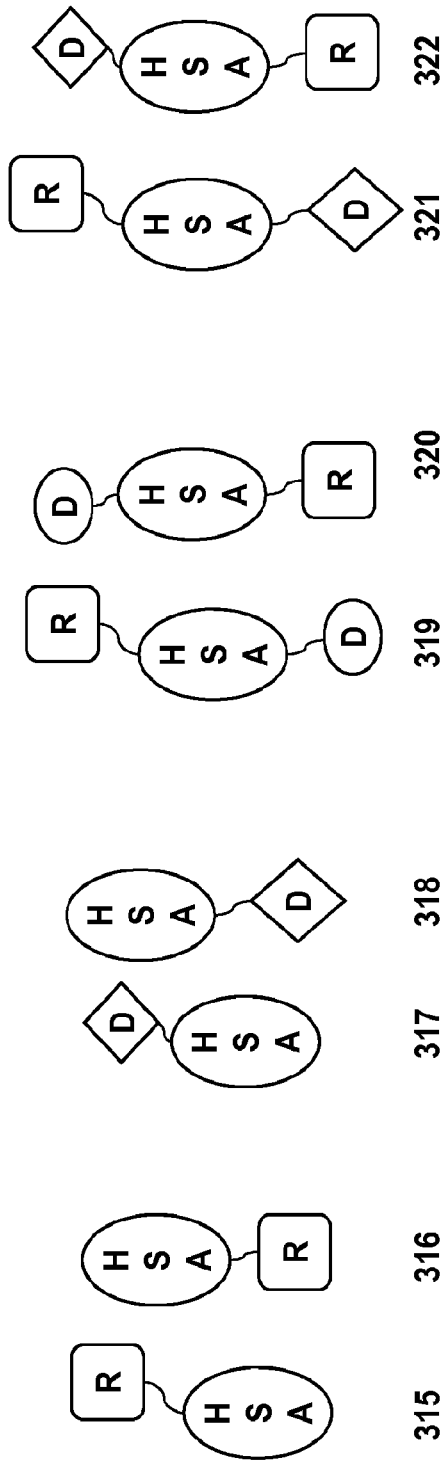
Figure 1C:
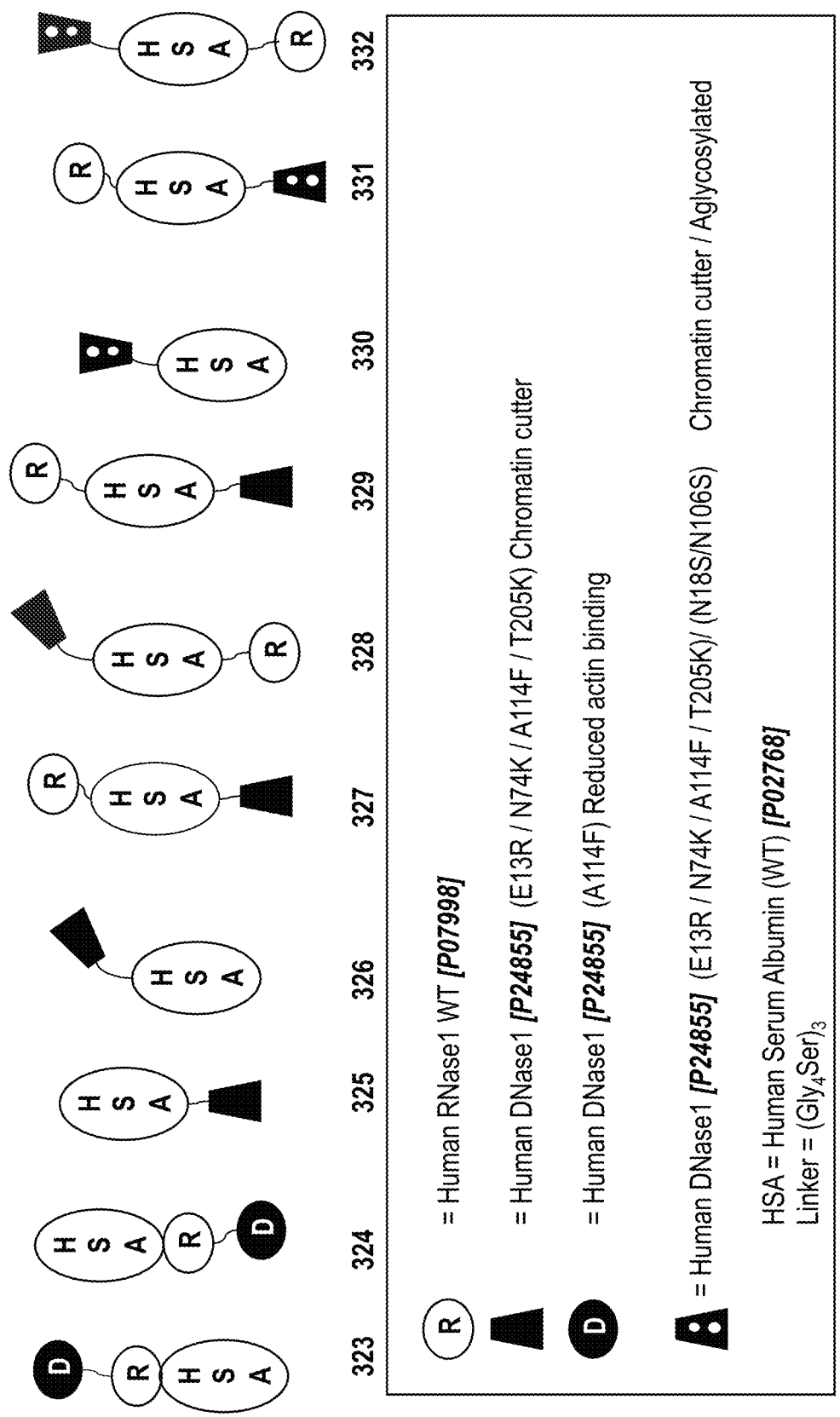

FIG. 1 displays exemplary configurations of the hybrid nuclease-albumin molecules, and Table 1 provides the sequences of exemplary hybrid nuclease-albumin molecules of various configurations.

In some embodiments, a hybrid nuclease-albumin molecule is an RNase domain or DNase domain or a multi-nuclease domain (e.g., both RNase and DNase or two RNA or DNA nucleases with different specificity for substrate) fused to an albumin, or a variant or fragment thereof, that specifically binds to extracellular immune complexes. In some embodiments, the albumin, or a variant or fragment thereof, shows increased binding to the FcRn receptor, thereby increasing the serum half-life and bioavailability of the hybrid nuclease-albumin molecule in circulation. In other embodiments, the hybrid nuclease-albumin molecule has activity against single and/or double-stranded RNA substrates.

In one embodiment, the nuclease domain is operably coupled (e.g., chemically conjugated or genetically fused (e.g., either directly or via a polypeptide linker)) to the N-terminus of an albumin, or a variant or fragment thereof. In another embodiment, the nuclease domain is operably coupled (e.g., chemically conjugated or genetically fused (e.g., either directly or via a polypeptide linker)) to the C-terminus of an albumin, or a variant or fragment thereof. In other embodiments, a nuclease domain is operably coupled (e.g., chemically conjugated or genetically fused (e.g., either directly or via a polypeptide linker)) via an amino acid side chain of an albumin, or a variant or fragment thereof.

In certain embodiments, the hybrid nuclease-albumin molecules of the invention comprise two or more nuclease domains and at least one albumin, or a variant or fragment thereof. For example, nuclease domains may be operably coupled to both the N-terminus and C-terminus of an albumin, or a variant or fragment thereof, with optional linkers between the nuclease domains and the albumin, or variant or fragment thereof. In some embodiments, the nuclease domains are identical, e.g., RNase and RNase, or DNase1 and DNase1. In other embodiments, the nuclease domains are different, e.g., DNase and RNase.

In other embodiments, two or more nuclease domains are operably coupled to each other (e.g., via a polypeptide linker) in series, and the tandem array of nuclease domains is operably coupled (e.g., chemically conjugated or genetically fused (e.g., either directly or via a polypeptide linker)) to either the C-terminus or the N-terminus of an albumin, or a variant or fragment thereof. In other embodiments, the tandem array of nuclease domains is operably coupled to both the C-terminus and the N-terminus of an albumin, or a variant or fragment thereof.

In other embodiments, one or more nuclease domains may be inserted between two albumins, or variants or fragments thereof. For example, one or more nuclease domains may form all or part of a polypeptide linker of a hybrid nuclease-albumin molecule of the invention.

Preferred hybrid nuclease-albumin molecules of the invention comprise at least one nuclease domain (e.g., RNase or DNase), at least one linker domain, and at least one albumin, or a variant or fragment thereof.

Accordingly, in some embodiments, the hybrid nuclease-albumin molecules of the invention comprise albumin, or a variant or fragment thereof, as described supra, thereby increasing serum half-life and bioavailability of the hybrid nuclease-albumin molecules. In some embodiments, a hybrid nuclease-albumin molecule is as shown in any of SEQ ID NOs: 18-65, 110-125, and 138-139.

It will be understood by the skilled artisan that other configurations of the nuclease domains and albumin are possible, with the inclusion of optional linkers between the nuclease domains and/or between the nuclease domains and albumin. It will also be understood that domain orientation can be altered, so long as the nuclease domains are active in the particular configuration tested.

In certain embodiments, the hybrid nuclease-albumin molecules of the invention have at least one nuclease domain specific for a target molecule which mediates a biological effect. In another embodiment, binding of the hybrid nuclease-albumin molecules of the invention to a target molecule (e.g. DNA or RNA) results in the reduction or elimination of the target molecule, e.g., from a cell, a tissue, or from circulation.

In other embodiments, the hybrid nuclease-albumin molecules of the invention may be assembled together or with other polypeptides to form binding proteins having two or more polypeptides ("multimers"), wherein at least one polypeptide of the multimer is a hybrid nuclease-albumin molecule of the invention. Exemplary multimeric forms include dimeric, trimeric, tetrameric, and hexameric altered binding proteins and the like. In one embodiment, the polypeptides of the multimer are the same (i.e., homomeric altered binding proteins, e.g., homodimers, homotetramers). In another embodiment, the polypeptides of the multimer are different (e.g., heteromeric).

In some embodiments, a hybrid nuclease-albumin molecule has a serum half-life that is increased at least about 1.5-fold, such as at least 3-fold, at least 5-fold, at least 10-fold, at least about 20-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1000-fold, or 1000-fold or greater relative to the corresponding nuclease molecule which is not fused to an albumin, or a variant or fragment thereof. In other embodiments, a hybrid nuclease-albumin molecule has a serum half-life that is decreased by at least about 1.5-fold, such as at least 3-fold, at least 5-fold, at least 10-fold, at least about 20-fold, at least about 50-fold, at least about 100-fold, at least about 200-fold, at least about 300-fold, at least about 400-fold, at least about 500-fold, or 500-fold or lower relative to the corresponding nuclease molecule which is not fused to an albumin, or a variant or fragment thereof. Routine art-recognized methods can be used to determine the serum half-life of hybrid nuclease-albumin molecules of the invention.

In some embodiments, the activity of the RNase in the hybrid nuclease-albumin molecule is not less than about 10-fold less, such as 9-fold less, 8-fold less, 7-fold less, 6-fold less, 5-fold less, 4-fold less, 3-fold less, or 2-fold less than the activity of a control RNase molecule. In some embodiments, the activity of the RNase in the hybrid nuclease-albumin molecule is about equal to the activity of a control RNase molecule.

In some embodiments, the activity of the DNase in the hybrid nuclease-albumin molecule is not less than about 10-fold less, such as 9-fold less, 8-fold less, 7-fold less, 6-fold less, 5-fold less, 4-fold less, 3-fold less, or 2-fold less than the activity of a control DNase molecule. In some embodiments, the activity of the DNase in the hybrid nuclease-albumin molecule is about equal to the activity of a control DNase molecule.

In some embodiments, the hybrid nuclease-albumin molecules include an albumin, or a variant or fragment thereof, that, e.g., allows binding to the FcRn receptor and thereby increases serum half-life and bioavailability. In some embodiments, the hybrid nuclease-albumin molecules can be active towards extracellular immune complexes containing DNA and/or RNA, e.g., either in soluble form or deposited as insoluble complexes.

In some embodiments, the activity of the hybrid nuclease-albumin molecule is detectable in vitro and/or in vivo.

In another aspect, a multifunctional RNase or DNase molecule is provided that is attached to another enzyme or antibody having binding specificity, such as an scFv targeted to RNA or DNA or a second nuclease domain with the same or different specificities as the first domain.

In some embodiments, linker domains include (Gly$_4$Ser) 3, 4 or 5 variants that alter the length of the linker by 5 amino acid progressions. In another embodiment, a linker domain is approximately 18 amino acids in length and includes an N-linked glycosylation site, which can be sensitive to protease cleavage in vivo. In some embodiments, an N-linked glycosylation site can protect the hybrid nuclease-albumin molecules from cleavage in the linker domain. In some embodiments, an N-linked glycosylation site can assist in separating the folding of independent functional domains separated by the linker domain.

In some embodiments, the hybrid nuclease-albumin molecule includes substantially all or at least an enzymatically active fragment of a DNase. In some embodiments, the DNase is a Type I secreted DNase, preferably a human DNase such as mature human pancreatic DNase1 (UniProtKB entry P24855, SEQ ID NO: 66; precursor human DNase1, SEQ ID NO: 67). In some embodiments, a naturally occurring variant allele, A114F (SEQ ID NO: 68), which shows reduced sensitivity to actin, is included in a DNase1 hybrid nuclease-albumin molecule (see Pan et al., *JBC* 1998; 273:18374-81; Zhen et al., *BBRC* 1997; 231:499-504; Rodriguez et al., *Genomics* 1997; 42:507-13). In other embodiments, a naturally occurring variant allele, G105R (SEQ ID NO: 69), which exhibits high DNase activity relative to wild type DNase1, is included in a DNase1 hybrid nuclease-albumin molecule (see Yasuda et al., *Int J Biochem Cell Biol* 2010; 42:1216-25). In some embodiments, this mutation is introduced into a hybrid nuclease-HSA molecule to generate a more stable derivative of human DNase1. In some embodiments, the DNase is human, wild type DNase1 or human, DNase1 A114F mutated to remove potential N-linked glycosylation sites, i.e., asparagine residues at positions 18 and 106 of the DNase1 domain set forth in SEQ ID NO: 66 (i.e., human DNase1 N18S/N106S/A114F, SEQ ID NO: 83), which correspond to asparagine residues at positions 40 and 128, respectively, of full length pancreatic DNase1 with the native leader (SEQ ID NO: 67).

In some embodiments, the DNase is a human DNase1 comprising one or more basic (i.e., positively charged) amino acid substitutions to increase DNase functionality and chromatin cleavage. In some embodiments, basic amino acids are introduced into human DNase1 at the DNA binding interface to enhance binding with negatively charged phosphates on DNA substrates (see U.S. Pat. Nos. 7,407,785; 6,391,607). This hyperactive DNase1 may be referred to as "chromatin cutter."

In some embodiments, 1, 2, 3, 4, 5 or 6 basic amino acid substitutions are introduced into DNase1. For example, one or more of the following residues is mutated to enhance DNA binding: Gln9, Glu13, Thr14, His44, Asn74, Asn110, Thr205. In some embodiments one or more of the foregoing amino acids are substituted with basic amino acids such as, arginine, lysine and/or histidine. For example, a mutant human DNase can include one or more of the following substitutions: Q9R, E13R, T14K, H44K, N74K, N110R, T205K. In some embodiments, the mutant human DNase1 also includes an A114F substitution, which reduces sensitivity to actin (see U.S. Pat. No. 6,348,343). In one embodiment, the mutant human DNase1 includes the following substitutions: E13R, N74K, A114F and T205K.

In some embodiments, the mutant human DNase1 further includes mutations to remove potential glycosylation sites, e.g., asparagine residues at positions 18 and 106 of the DNase1 domain set forth in SEQ ID NO:66, which correspond to asparagines residues at positions 40 and 128, respectively of full length pancreatic DNase1 with the native leader (SEQ ID NO:67). In one embodiment, the mutant human DNase1 includes the following substitutions: E13R/N74K/A114F/T205K/N18S/N106S.

In some embodiments, the DNase is DNase1-like (DNaseL) enzyme, 1-3 (UniProtKB entry Q13609; SEQ ID NO: 70). In some embodiments, the DNase is three prime repair exonuclease 1 (TREX1; UniProtKB entry Q9NSU2; SEQ ID NO: 71). In some embodiments, the DNase is DNase2. In some embodiments, the DNase2 is DNAse2 alpha (i.e., DNase2; UnitProtKB entry O00115 SEQ ID NO: 72) or DNase2 beta (i.e., DNase2-like acid DNase; UnitProtKB entry Q8WZ79; SEQ ID NO: 73). In some embodiments, the N-linked glycosylation sites of DNase 1L3, TREX1, DNase2 alpha, or DNase2 beta are mutated such as to remove potential N-linked glycosylation sites.

In some embodiments, a DNase-linker-albumin containing a 20 or 25 aa linker domain is made. In some embodiments, hybrid nuclease-albumin molecules include RNase-albumin-linker-DNase1, wherein the DNase1 domain is located at the COOH side of the albumin. In other embodiments, hybrid nuclease-albumin molecules include DNase1-albumin-linker-RNase, wherein the DNase1 domain is located at the NH2 side of the albumin. In some embodiments, hybrid nuclease-albumin molecules are made that incorporate DNase1 and include: DNase1-albumin, DNase1-linker-albumin, albumin-DNase1, albumin-linker-DNase1, DNase1-albumin-RNase, RNase-albumin-DNase1, DNase1-linker-albumin-linker-RNase, RNase-linker-albumin-linker-DNase1, DNase1-linker-RNase-albumin, RNase-linker-DNase1-albumin, albumin-DNase1-linker-RNase, and albumin-RNase-linker-DNase1. Exemplary configurations of the hybrid nuclease-albumin molecules comprising DNase1 are shown in FIG. 1. In these embodiments, RNase can be, for example, human RNase1.

In some embodiments, a hybrid nuclease-albumin molecule includes TREX1 (SEQ ID NO: 71). In some embodiments, a TREX1 hybrid nuclease-albumin molecule can digest chromatin. In some embodiments, a TREX1 hybrid nuclease-albumin molecule is expressed by a cell. In some embodiments, the expressed hybrid nuclease-albumin molecule includes murine TREX-1 and an albumin, or a variant or fragment thereof. In some embodiments, a hydrophobic region of approximately 72 aa can be removed from the COOH end of TREX-1 prior to fusion to albumin, or a variant or fragment thereof, via the linker domain. In some embodiments, a 20 amino acid linker domain version of the hybrid nuclease-albumin molecule exhibits high expression levels compared to controls and/or other hybrid nuclease-albumin molecules. In some embodiments, kinetic enzyme assays are used to compare the enzyme activity of hybrid nuclease-albumin molecules and controls in a quantitative manner.

In some embodiments, further optimization of the fusion junction chosen for truncation of a TREX1 enzyme can be used to improve expression of the hybrid nuclease-albumin molecules.

In some embodiments, the hybrid nuclease-albumin molecule includes a human TREX1-linker-albumin domain hybrid nuclease-albumin molecule with 20 and/or 25 aa linker domains. In some embodiments, the linker domain(s) are variants of a (Gly$_4$Ser)$_4$ or (Gly$_4$Ser)$_5$ cassette with one or more restriction sites attached for incorporation into the hybrid nuclease-albumin molecules construct. In some embodiments, because of the head-to-tail dimerization useful for TREX1 enzyme activity; a flexible, longer linker domain can be used to facilitate proper folding.

In some embodiments, the hybrid nuclease-albumin molecule is a TREX1-tandem hybrid nuclease-albumin molecule. In some embodiments, an alternative method for facilitating head-to-tail folding of TREX1 is to generate a TREX1-TREX1-albumin hybrid nuclease-albumin molecule that incorporates two TREX1 domains in tandem, followed by a linker domain and an albumin domain. In some embodiments, positioning of TREX1 cassettes in a head-to-tail manner can be corrected for head-to tail folding on either arm of the immunoenzyme and introduce a single TREX1 functional domain into each arm of the molecule. In some embodiments, each immunoenzyme of a hybrid nuclease-albumin molecule has two functional TREX1 enzymes attached to a single HSA, or a variant or fragment thereof.

In some embodiments, the hybrid nuclease-albumin molecule includes TREX1-linker1-albumin-linker2-RNase. In some embodiments, the hybrid nuclease-albumin molecule includes RNase-albumin-linker-TREX1. In some embodiments, cassettes are derived for both amino and carboxyl fusion of each enzyme for incorporation into hybrid nuclease-albumin molecules where the enzyme configuration is reversed. In some embodiments, the RNase enzyme exhibits comparable functional activity regardless of its position in the hybrid nuclease-albumin molecules. In some embodiments, alternative hybrid nuclease-albumin molecules can be designed to test whether a particular configuration demonstrates improved expression and/or function of the hybrid nuclease-albumin molecule components.

In some embodiments, the hybrid nuclease-albumin molecule includes DNase 1L3-albumin. In some embodiments, the DNase 1L3 is constructed from a human (SEQ ID NO: 70) or murine (SEQ ID NO: 74) sequence and expressed. In some embodiments, a human DNase 1L3-albumin-RNase hybrid nuclease-albumin molecule is constructed and expressed. In some embodiments, the molecule includes human DNase 1L3-albumin, human DNase 1L3-albumin-RNase, and/or human RNase-albumin-DNase 1L3.

In some embodiments, the hybrid nuclease-albumin molecule includes DNase2 alpha (SEQ ID NO: 72) or DNase2 beta (SEQ ID NO: 73). In some embodiments, a human DNase2 alpha-albumin-RNase or human DNase2 beta-albumin-RNase hybrid nuclease-albumin molecule is constructed and expressed. In some embodiments, the molecule includes human DNase2 alpha-albumin, human DNase2 alpha-albumin-RNase, and/or human RNase-albumin-DNase2 alpha. In other embodiments, the molecule includes human DNase2 beta-albumin, human DNase2 beta-albumin-RNase, and/or human RNase-albumin-DNase2 beta.

In some embodiments, the hybrid nuclease-albumin molecule includes a RNase1, preferably human pancreatic RNase1 (UniProtKB entry P07998; mature hRNase1, SEQ ID NO: 75; precursor hRNase1, SEQ ID NO: 76) of the RNase A family. In some embodiments, the human RNase1 is mutated to remove all potential N-linked glycosylation sites, i.e., asparagine residues at positions 34, 76, and 88 of the RNase1 domain set forth in SEQ ID NO: 75 (human RNase1 N34S/N76S/N88S, SEQ ID NO: 84), which correspond to asparagine residues at positions 62, 104, and 116, respectively, of full length pancreatic RNase1 with the native leader (SEQ ID NO: 76). One of ordinary skill in the art would be able to determine that positions 34, 76, and 88 of the RNAase1 domain set for in SEQ ID NO: 75 would change depending on the length of a leader sequence included in the construct. In some embodiments, the hybrid nuclease-albumin molecule is human RNase1 linked to albumin via a 20-25 amino acid linker domain. In some embodiments, hybrid nuclease-albumin molecules include DNase-albumin-linker-RNase1, wherein the RNase1 domain is located at the COOH side of the albumin. In other embodiments, hybrid nuclease-albumin molecules include RNase1-albumin-linker-DNase, wherein the RNase1 domain is located at the NH2 side of the albumin. In some embodiments, the hybrid nuclease-albumin molecules incorporate human RNase1 and include: RNase1-albumin, RNase1-linker-albumin, albumin-RNase1, albumin-linker-RNase1, RNase1-albumin-DNase, DNase-albumin-RNase1, RNase1-linker-albumin-linker-DNase, DNase-linker-albumin-linker-RNase1, RNase1-linker-DNase-albumin, DNase-linker-RNase1-albumin, albumin-RNase1-linker-DNase, and albumin-DNase-linker-RNase1. Exemplary configurations of the hybrid nuclease-albumin molecules comprising RNase1 are shown in FIG. 1. In these embodiments, DNase can be, for example, human DNase1.

In some embodiments, fusion junctions between enzyme domains and the other domains of the hybrid nuclease-albumin molecule is optimized.

In some embodiments, the targets of the RNase enzyme activity of RNase hybrid nuclease-albumin molecules are primarily extracellular, consisting of, e.g., RNA contained in immune complexes with anti-RNP autoantibody and RNA expressed on the surface of cells undergoing apoptosis. In some embodiments, the RNase hybrid nuclease-albumin molecule is active in the acidic environment of the endocytic vesicles. In some embodiments, an RNase hybrid nuclease-albumin molecule including an albumin, or a variant or fragment thereof, is adapted to be active both extracellularly and in the endocytic environment. In some aspects, this allows an RNase hybrid nuclease-albumin molecule including a wild-type HSA, or a variant or fragment thereof, to stop TLR7 signaling through previously engulfed immune complexes or by RNAs that activate TLR7 after viral infection. In some embodiments, the wild type RNase of an RNase hybrid nuclease-albumin molecule is not resistant to inhibition by an RNase cytoplasmic inhibitor. In some embodiments, the wild type RNase of an RNase hybrid nuclease-albumin molecule is not active in the cytoplasm of a cell.

In some embodiments, hybrid nuclease-albumin molecules include both DNase and RNase. In some embodiments, these hybrid nuclease-albumin molecules can improve the therapy of SLE because they can, e.g., digest immune complexes containing RNA, DNA, or a combination of both RNA and DNA; and when they further include an albumin, or a variant or fragment thereof, they are active both extracellularly and in the endocytic compartment where TLR7 and TLR9 can be located.

Albumin, or a Variant or Fragment Thereof

Suitable albumins for use in the hybrid nuclease-albumin molecules can be from human, primate, rodent, bovine, equine, donkey, rabbit, goat, sheep, dog, chicken, or pig. In some embodiments, the albumin is a serum albumin, for example, a human serum albumin (SEQ ID NO: 1), primate serum albumin (e.g., chimpanzee serum albumin, gorilla serum albumin), rodent serum albumin (e.g., hamster serum albumin, guinea pig serum albumin, mouse albumin and rat serum albumin), bovine serum albumin, equine serum albumin, donkey serum albumin, rabbit serum albumin, goat serum albumin, sheep serum albumin, dog serum albumin, chicken serum albumin and pig serum albumin.

The albumin, or a variant or fragment thereof, portion of the hybrid nuclease-albumin molecule according to the invention generally has a sequence identity to the sequence of wild-type HSA as set forth in SEQ ID NO: 1 of at least 50%, such as at least 60%, at least 70%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%.

In one aspect, the number of alterations, e.g., substitutions, insertions, or deletions, in the albumin variants of the present invention is 1-20, e.g., 1-10 and 1-5, such as 1, 2, 3, 4, 5, 6, 7, 8, 9 or 10 alterations compared to the corresponding wild-type albumin (e.g., HSA).

In addition to wild-type albumin, albumin variants with increased serum half-life relative to the wild-type albumin, and/or that increase the serum half-life of molecules they are fused or conjugated to, are considered applicable as fusion partners with the nuclease molecules of the invention. Non-limiting examples of such variants include one or more alterations (e.g., substitutions, deletions, or insertions) in one or more positions corresponding to positions 417, 440, 464, 490, 492, 493, 494, 495, 496, 499, 500, 501, 503, 504, 505, 506, 510, 535, 536, 537, 538, 540, 541, 542, 550, 573, 574, 575, 577, 578, 579, 580, 581, 582 and 584 of HST (SEQ ID NO: 1). In some embodiments, a variant comprises an alteration of at least one of these positions, such as 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, or all of these positions. The substitution(s) may be any substitution(s) where the amino acid in the natural albumin sequence is substituted with a different amino acid selected among the remaining 19 natural occurring amino acids, provided that the substitution(s) increases the half-life of the nuclease molecule it is fused or conjugated to relative to the nuclease molecule not fused to the variant or a nuclease molecule fused to the wild-type albumin. Exemplary variants with altered serum half-life and/or binding to FcRn are those that include one or more of the following amino acid substitutions in HST (SEQ ID NO: 1), as disclosed in U.S. Published Application No. 2012-0220530: Q417A, Q417H, H440Q, H464Q, A490D, E492G, E492T, E492P, E492H, V493P, V493L, D494N, D494Q, D494A, D494E, D494P, E495Q, E495A, T496A, P499A, K500E, K500G, K500A, K500S, K500C, K500P, K500H, K500F, K500N, K500W, K500T, K500M, K500Y, K500V, K500Q, K500L, K500I, K500R, E501A, E501P, E501Q, N503K, N503D, E503H, A504E, E505K, E505D, T506F, T506S, H510Q, H535Q, K536A, P537A, K538A, K538H, T540S, K541A, K541D, K541G, K541N, K541E, E542P, E542D, D550N, K573Y, K573W, K573P, K573H, K573F, K573V, K573I, K573T, K573N, K573S, K573G, K573M, K573C, K573A, K573E, K573Q, K573R, K573L, K573D, K574N, Q580K, L575F, A577T, A577E, A578R, A578S, S579C, S579T, Q580K, A581D, A582T, G584A (the contents of which are incorporated herein by reference). In particular embodiments, the variant has position 573 of HST (SEQ ID NO: 1) substituted with proline (P), tryptophan (W), or tyrosine (Y). In yet other embodiments, the variant comprises multiple alterations, such as substitutions, at positions corresponding to 494 and 496; 492 and 493; 494 and 417; 492 and 503; 492 and 573 (e.g., E492G+K573P, E492G+K573A); and 492, 503, and 573 (e.g., E492G+N503H+K573P). It should be understood that variants containing any alteration (e.g., substitution, insertion, deletion) at any one of the above positions of HSA (SEQ ID NO: 1), or at any other position(s), are suitable for use in the hybrid nuclease-albumin molecules of the invention provided that they alter the half-life of the hybrid nuclease-albumin molecules relative to a non-fused or non-conjugated nuclease domain or a nuclease domain fused or conjugated to the corresponding wild-type albumin.

Albumin variants with increased serum half-life, as disclosed in WO2011/051489, include E492G, K500R, N503H, N503K, D550E, K573Y, K573W, K573P, K573H, K573F, K573V, K573I, K573T, K573N, K573S, K573G, K573M, K573C, K573A, K573E, K573Q, K573R, K573L, K573D, K574N, Q580K, E492G+N503K, E492G+N503H, E492G+K573A, E492G+K573P, E492G+N503K+K573P, E492G+N503H+K573P, E492G+N503K+K573A K573P+L575F+G584A, K573P+A578S+S579T+G584A, K573P+A577E+A578S+Q580K+A582T, K573P+K574N+A577T+A578R+S579C+Q580K+A581D+G584A, and E492H+E501P+N503H+E505D+T506S+T540S+K541E. It will be evident to the skilled artisan that variants with other amino acid substitutions or combinations of amino acid substitutions can be readily tested with routine methods to determine whether they exhibit increased serum half-life.

Some natural variants of albumin also exhibit increased serum half-life, and are suitable for use in the hybrid nuclease-albumin molecules of the invention. Such natural HSA variants with increased serum half-life are known in the art, such as E501K, E570K (Iwao et al. 2007, *B.B.A. Proteins and Proteomics* 1774, 1582-90), E505K (Gallino et al., supra), K536E, K574N (Minchiotti et al., *Biochim*

Biophys Acta 1987:916:411-418), D550G (Takahashi et al., PNAS 1987:84:4413-7), and D550A (Carlson et al., PNAS 1992:89:8225-9).

It will be understood by the skilled artisan that any albumin variant or natural variant with increased serum half-life compared to the corresponding wild-type albumin (e.g., HSA), or that increases the serum half-life of the nuclease domain it is fused or conjugated to, is suitable for use in hybrid nuclease-albumin molecules.

In some embodiments, the variant albumin has an amino acid substitution that increases the affinity of the albumin to FcRn, which correlates with increased serum half-life. Such amino acid substitutions include, but are not limited to, HSA with K573P (i.e., lysine at position 573 substituted with a proline). Routine methods, such as surface plasmon resonance (SPR), as disclosed in WO2011/051489, can be used to determine whether a particular albumin variant exhibits increased affinity to FcRn relative to the corresponding wild-type albumin. It will be evident to the skilled artisan that increased affinity to FcRn can be determined by comparing the binding constants KD of the albumin variant and wild-type albumin. In the context of the present invention, variant albumins having a KD that is lower than the KD for natural HSA is considered to have a higher plasma half-life than HSA.

In certain embodiments, it may be desirable for the variant albumin, or fragment thereof, to decrease the serum half-life of a hybrid nuclease-albumin molecule. Such variant albumins, or fragments thereof, may decrease the binding of the hybrid nuclease-albumin molecules to FcRn relative to the non-albumin fused nuclease molecules or hybrid nuclease-albumin molecules in which albumin is the corresponding wild-type albumin. Hybrid nuclease-albumin molecules with decreased serum half-lives, e.g., those with decreased FcRn binding affinity, are useful, for example, for administration to a mammal where a shortened circulation time may be advantageous, e.g., for in vivo diagnostic imaging or in situations where the starting polypeptide has toxic side effects when present in the circulation for prolonged periods. Albumin variants with decreased FcRn binding affinity are also less likely to cross the placenta and, thus, are also useful in the treatment of diseases or disorders in pregnant women. In addition, other applications in which reduced FcRn binding affinity may be desired include those applications in which localization the brain, kidney, and/or liver is desired. In one exemplary embodiment, the hybrid nuclease-albumin molecules of the invention exhibit reduced transport across the epithelium of kidney glomeruli from the vasculature. In another embodiment, the hybrid nuclease-albumin molecules of the invention exhibit reduced transport across the blood brain barrier (BBB) from the brain, into the vascular space. In one embodiment, a hybrid nuclease-albumin molecule with altered FcRn binding comprises at least one albumin domain (e.g., domain III of HSA) having one or more amino acid substitutions within the "FcRn binding region" of an albumin domain. Exemplary albumin variants that exhibit decreased serum half-life are disclosed in, e.g., WO2011/124718, and include Q417A, H464Q, D494N, D494Q, D494A, E495Q, E495A, T496A, P499A, K500E, K500G, K500D, K500A, K500S, K500C, K500P, K500H, K500F, K500N, K500W, K500T, K500M, K500Y, K500V, K500Q, K500L, K500I, K500R, D500N, E501A, E501Q, N503K, N503D, H510Q, H535Q, K536A, P537A, K541G, K541D, K541A, K541N, E492T+N503D, E492G+V493P, D494E+Q417H, E495Q+T496A, D494N+E495Q+T496A, E492G+K538H+K541N+E542D, E492G+V493P+K538H+ K541N+E542D, A490D+E492T+V493L+E501P+E503D+ A504E+E505K+T506F+K541D. Exemplary natural albumin variants that exhibit decreased serum half-life include D494N (Peach et al., Biochim Biophys Acta 1991; 1097:49-54), and K541E and K560E (Iwao et al., B.B.A. Proteins and Proteomics 2007; 1774:1582-90).

One or more positions of albumin, or a variant or fragment thereof, can be altered to provide reactive surface residues for, e.g., conjugation with a DNase and/or RNase domain. Exemplary positions in HSA (SEQ ID NO: 1) that can be altered to provide conjugation competent cysteine residues include, but are not limited to, those disclosed in WO2010/092135, such as, D1C, A2C, T79C, E82C, E86C, D121C, D129C, S270C, A364C, A504C, E505C, D549C, D562C, A578C, A579C, A581C, L585C, and L595C. Alternatively a cysteine residue may be added to the N or C terminus of albumin. Methods suitable for producing conjugation competent albumin, or a variant or peptide thereof, as well as covalently linking albumin, or a variant or fragment thereof, with a conjugation partner or partners (e.g., an RNase and/or DNase domain) are routine in the art and disclosed in, e.g., WO2010/092135 and WO 2009/019314. In one embodiment, the conjugates may conveniently be linked via a free thio group present on the surface of HSA (amino acid residue 34 of mature HSA) using art-recognized methods.

In addition to the albumin or variants thereof described supra, fragments of albumin, or fragments of variants thereof, are suitable for use as the albumin component of the hybrid nuclease-albumin molecules of the invention. Exemplary albumin fragments that are suitable for use in the hybrid nuclease-albumin fusions are disclosed in WO 2011/124718. A fragment of albumin (e.g., a fragment of HSA) will typically be at least 20 amino acids in length, such as at least 40 amino acids, at least 60 amino acids, at least 80 amino acids, at least 100 amino acids, at least 150 amino acids, at least 200 amino acids, at least 300 amino acids, at least 400 amino acids, or at least 500 amino acids in length, and will alter (e.g., increase) the serum half-life of the nuclease domain it is fused to (e.g., RNase and/or DNase domain) relative to the non-fused nuclease domain.

In some embodiments, a fragment may comprise at least one whole sub-domain of albumin. Domains of HSA have been expressed as recombinant proteins (Dockal et al., JBC 1999; 274:29303-10), where domain I was defined as consisting of amino acids 1-197 (SEQ ID NO: 77), domain II was defined as consisting of amino acids 189-385 (SEQ ID NO: 78), and domain III was defined as consisting of amino acids 381-585 (SEQ ID NO: 79) of HSA (SEQ ID NO: 1). Partial overlap of the domains occurs given the extended α-helix structure (h10-h1) which exists between domains I and II, and between domains II and III (Peters, 1996, op. cit, Table 2-4). HSA also comprises six sub-domains (sub-domains IA, IB, NA, NB, INA and NIB). Sub-domain IA comprises amino acids 6-105, sub-domain IB comprises amino acids 120-177, sub-domain NA comprises amino acids 200-291, sub-domain NB comprises amino acids 316-369, sub-domain INA comprises amino acids 392-491 and sub-domain NIB comprises amino acids 512-583 of SEQ ID NO: 1.

A fragment may comprise a whole or part of one or more domains or sub-domains as defined above, or any combination of those domains and/or sub-domains. A fragment may comprise or consist of at least 50, 60, 70, 75, 80, 85, 90, 95, 96, 97, 98, or 99% of an albumin or of a domain of an albumin, or a variant or fragment thereof. Additionally, single or multiple heterologous fusions comprising any of the above; or single or multiple heterologous fusions to albumin, or a variant or fragment of any of these may be used. Such fusions include albumin N-terminal fusions, albumin C-terminal fusions and co-N-terminal and C-terminal albumin fusions as exemplified by WO 01/79271. In some embodiments, the fragment of albumin or variant thereof retains the ability to bind to FcRn. In one embodiment, the hybrid nuclease-albumin molecules contain domain III of albumin, or a variant thereof. In another embodiment, the hybrid nuclease albumin molecules contain domain III of albumin and an additional domain selected from the group consisting of domain I, domain II, and domain III. In yet another embodiment, the hybrid nuclease albumin molecules contain domains I, II, and III of albumin.

Linker Domains

In some embodiments, a hybrid nuclease-albumin molecule includes a linker domain. In some embodiments, a hybrid nuclease-albumin molecule includes a plurality of linker domains. In some embodiments, the linker domain is a polypeptide linker. In certain aspects, it is desirable to employ a polypeptide linker to fuse albumin, or a variant or fragment thereof, with one or more nuclease domains to form a hybrid nuclease-albumin molecule.

In one embodiment, the polypeptide linker is synthetic. As used herein, the term "synthetic" with respect to a polypeptide linker includes peptides (or polypeptides) which comprise an amino acid sequence (which may or may not be naturally occurring) that is linked in a linear sequence of amino acids to a sequence (which may or may not be naturally occurring) (e.g., an albumin sequence) to which it is not naturally linked in nature. For example, the polypeptide linker may comprise non-naturally occurring polypeptides which are modified forms of naturally occurring polypeptides (e.g., comprising a mutation such as an addition, substitution or deletion) or which comprise a first amino acid sequence (which may or may not be naturally occurring). The polypeptide linkers of the invention may be employed, for instance, to ensure that albumin, or a variant or fragment thereof, is juxtaposed to ensure proper folding and formation of a functional albumin, or a variant or fragment thereof. Preferably, a polypeptide linker compatible with the instant invention will be relatively non-immunogenic and not inhibit any non-covalent association among monomer subunits of a binding protein.

In certain embodiments, the hybrid nuclease-albumin molecules of the invention employ a polypeptide linker to join any two or more domains in frame in a single polypeptide chain. In one embodiment, the two or more domains may be independently selected from any of the albumins, or variants or fragments thereof, or nuclease domains discussed herein. For example, in certain embodiments, a polypeptide linker can be used to fuse identical albumin fragments, thereby forming a homomeric albumin region. In other embodiments, a polypeptide linker can be used to fuse different albumin fragments (e.g., domains I and III, or domains II and III of HSA), thereby forming a heteromeric albumin region. In other embodiments, a polypeptide linker of the invention can be used to genetically fuse the C-terminus of a first albumin fragment to the N-terminus of a second albumin fragment to form a complete albumin domain.

In one embodiment, a polypeptide linker comprises a portion of an albumin, or a variant or fragment thereof. For example, in one embodiment, a polypeptide linker can comprise an albumin fragment (e.g., domain I, II, or III), or a different portion of an albumin or variant thereof.

In another embodiment, a polypeptide linker comprises or consists of a gly-ser linker. As used herein, the term "gly-ser linker" refers to a peptide that consists of glycine and serine residues. An exemplary gly/ser linker comprises an amino acid sequence of the formula $(Gly_4Ser)_n$ (SEQ ID NO: 141), wherein n is a positive integer (e.g., 1, 2, 3, 4, or 5). In certain embodiments the gly/ser linker is $(Gly_4Ser)_1$ (SEQ ID NO: 142). In certain embodiments the gly/ser linker is $(Gly_4Ser)_2$ (SEQ ID NO: 143). In certain embodiments the gly/ser linker is $(Gly_4Ser)_3$ (SEQ ID NO: 85). In certain embodiments the gly/ser linker is $(Gly_4Ser)_4$ (SEQ ID NO: 144). In certain embodiments the gly/ser linker is $(Gly_4Ser)_5$ (SEQ ID NO: 145). In certain embodiments, the gly-ser linker may be inserted between two other sequences of the polypeptide linker (e.g., any of the polypeptide linker sequences described herein). In other embodiments, a gly-ser linker is attached at one or both ends of another sequence of the polypeptide linker (e.g., any of the polypeptide linker sequences described herein). In yet other embodiments, two or more gly-ser linker are incorporated in series in a polypeptide linker.

In other embodiments, a polypeptide linker of the invention comprises a biologically relevant peptide sequence or a sequence portion thereof. For example, a biologically relevant peptide sequence may include, but is not limited to, sequences derived from an anti-rejection or anti-inflammatory peptide. Said anti-rejection or anti-inflammatory peptides may be selected from the group consisting of a cytokine inhibitory peptide, a cell adhesion inhibitory peptide, a thrombin inhibitory peptide, and a platelet inhibitory peptide. In a preferred embodiment, a polypeptide linker comprises a peptide sequence selected from the group consisting of an IL-1 inhibitory or antagonist peptide sequence, an erythropoietin (EPO)-mimetic peptide sequence, a thrombopoietin (TPO)-mimetic peptide sequence, G-CSF mimetic peptide sequence, a TNF-antagonist peptide sequence, an integrin-binding peptide sequence, a selectin antagonist peptide sequence, an anti-pathogenic peptide sequence, a vasoactive intestinal peptide (VIP) mimetic peptide sequence, a calmodulin antagonist peptide sequence, a mast cell antagonist, a SH3 antagonist peptide sequence, an urokinase receptor (UKR) antagonist peptide sequence, a somatostatin or cortistatin mimetic peptide sequence, and a macrophage and/or T-cell inhibiting peptide sequence. Exemplary peptide sequences, any one of which may be employed as a polypeptide linker, are disclosed in U.S. Pat. No. 6,660,843, which is incorporated by reference herein.

Other linkers that are suitable for use in the hybrid nuclease-albumin molecules are known in the art, for example, the serine-rich linkers disclosed in U.S. Pat. No. 5,525,491, the helix forming peptide linkers (e.g., A(EAAAK)nA (n=2-5) (SEQ ID NO: 146)) disclosed in Arai et al., *Protein Eng* 2001; 14:529-32, and the stable linkers disclosed in Chen et al., *Mol Pharm* 2011; 8:457-65, i.e., the dipeptide linker LE, a thrombin-sensitive disulfide cyclopeptide linker, and the alpha-helix forming linker LEA (EAAAK)₄ALEA(EAAAK)₄ALE (SEQ ID NO: 89).

Other exemplary linkers include GS linkers (i.e., (GS)n), GGSG (SEQ ID NO: 81) linkers (i.e., (GGSG)n) (SEQ ID NO: 147), GSAT (SEQ ID NO: 82) linkers, SEG linkers, and GGS linkers (i.e., (GGSGGS)n) (SEQ ID NO: 148), wherein n is a positive integer (e.g., 1, 2, 3, 4, or 5). Other suitable linkers for use in the hybrid nuclease-albumin molecules can be found using publicly available databases, such as the Linker Database (ibi.vu.nl/programs/linkerdbwww). The Linker Database is a database of inter-domain linkers in multi-functional enzymes which serve as potential linkers in novel fusion proteins (see, e.g., George et al., *Protein Engineering* 2002; 15:871-9).

It will be understood that variant forms of these exemplary polypeptide linkers can be created by introducing one or more nucleotide substitutions, additions or deletions into the nucleotide sequence encoding a polypeptide linker such that one or more amino acid substitutions, additions or deletions are introduced into the polypeptide linker. Mutations may be introduced by standard techniques, such as site-directed mutagenesis and PCR-mediated mutagenesis.

Polypeptide linkers of the invention are at least one amino acid in length and can be of varying lengths. In one embodiment, a polypeptide linker of the invention is from about 1 to about 50 amino acids in length. As used in this context, the term "about" indicates +/− two amino acid residues. Since linker length must be a positive integer, the length of from about 1 to about 50 amino acids in length, means a length of from 1 to 48-52 amino acids in length. In another embodiment, a polypeptide linker of the invention is from about 10-20 amino acids in length. In another embodiment, a polypeptide linker of the invention is from about 15 to about 50 amino acids in length.

In another embodiment, a polypeptide linker of the invention is from about 20 to about 45 amino acids in length. In another embodiment, a polypeptide linker of the invention is from about 15 to about 25 amino acids in length. In another embodiment, a polypeptide linker of the invention is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, or 61 or more amino acids in length.

Polypeptide linkers can be introduced into polypeptide sequences using techniques known in the art. Modifications can be confirmed by DNA sequence analysis. Plasmid DNA can be used to transform host cells for stable production of the polypeptides produced.

Exemplary Hybrid Nuclease-Albumin Molecules

The hybrid nuclease-albumin molecules of the invention are modular, and can be configured to incorporate various individual domains. For example, in one embodiment, the hybrid nuclease-albumin molecule may include the mutant, human DNase1 A114F domain set forth in (SEQ ID NO: 68). In another embodiment, the hybrid nuclease-albumin molecule may include the mutant, human DNase1 N18S/N106S/A114F domain set forth in SEQ ID NO: 83. In yet another embodiment, the hybrid nuclease albumin molecule may include the mutant human DNase1 E13R/N74K/A114F/T205K domain set forth in SEQ ID NO:108 and/or the mutant human DNase1 E13R/N74K/A114F/T205K/N18S/N106S domain set forth in SEQ ID NO: 109.

In another embodiment, the hybrid nuclease-albumin molecule may include the human, wild-type RNase1 domain set forth in SEQ ID NO: 75. In another embodiment, the hybrid nuclease-albumin molecule may include the human, mutant RNase1 N34S/N76S/N88S domain set forth in SEQ ID NO: 84. In another embodiment, the hybrid nuclease-albumin molecule may include the HSA set forth in SEQ ID NO: 1. In another embodiment, the hybrid nuclease-albumin molecule may include the (Gly$_4$Ser)$_3$ (SEQ ID NO: 85) linker domain set forth in SEQ ID NO: 85. In another embodiment, the hybrid nuclease-HSA molecule may include a VK3LP leader (SEQ ID NO: 86). It will be understood to the skilled artisan that these individual domains can be operably coupled to each other in any order to form a hybrid nuclease-albumin molecule that is enzymatically active. For example, as detailed in the specific examples below, RNase1 can be operably coupled to HSA. In another example, RNase1 can be operably coupled to HSA via a (Gly$_4$Ser)$_3$ (SEQ ID NO: 85) linker domain. In yet another example, DNase1 A114F can be operably coupled to HSA. In yet another example, DNase1 A114F can be operably coupled to mature HSA via a (Gly$_4$Ser)$_3$ (SEQ ID NO: 85) linker domain. Various other configurations are possible, with non-limiting exemplary configurations detailed below and in FIG. 1.

In some embodiments, a hybrid nuclease-albumin molecule comprises a wild-type, human RNase1 domain operably coupled to a wild-type albumin, or a variant or fragment thereof. In one embodiment, the hybrid nuclease-albumin molecule comprises a VK3LP leader, followed by a wild-type HSA, or a variant or fragment thereof, operably coupled at its C-terminus to a human RNase1 domain (e.g., an HSA-RNase molecule; RSLV-301 (SEQ ID NO: 18)). In one embodiment, the HSA-RNase molecule lacks the VK3LP leader (SEQ ID NO: 42).

In another embodiment, the hybrid nuclease-albumin molecule comprises a VK3LP leader, followed by a wild-type, human RNase1 domain operably coupled to the N-terminus of wild-type HSA, or a variant or fragment thereof (e.g., an RNase-HSA molecule; RSLV-302 (SEQ ID NO: 19)). In one embodiment, the RNase-HSA molecule lacks the VK3LP leader (SEQ ID NO: 43).

In some embodiments, a hybrid nuclease-albumin molecule comprises a wild-type, human RNase1 domain operably coupled via a (Gly$_4$Ser)$_n$ (SEQ ID NO: 141) linker domain to a wild-type albumin, or mutant or fragment thereof. In one embodiment, the hybrid nuclease-albumin molecule comprises a VK3LP leader, followed by a wild-type HSA, or a variant or fragment thereof operably coupled at its C-terminus via a (Gly$_4$Ser)$_3$ (SEQ ID NO: 85) linker to a human RNase1 domain (e.g., an HSA-linker-RNase molecule; RSLV-303 (SEQ ID NO: 20)). In one embodiment, the HSA-linker-RNase molecule lacks the VK3LP leader (SEQ ID NO: 44).

In another embodiment, the hybrid nuclease-albumin molecule comprises a VK3LP leader, followed by a wild-type, human RNase1 domain operably coupled via a (Gly$_4$Ser)$_3$ (SEQ ID NO: 85) linker domain to the N-terminus of wild-type HSA, or a variant or fragment thereof (e.g., an RNase-linker-HSA molecule; RSLV-304 (SEQ ID NO: 21)). In one embodiment, the RNase-linker-HSA molecule lacks the VK3LP leader (SEQ ID NO: 45).

In some embodiments, a hybrid nuclease-albumin molecule comprises a wild-type, human RNase1 domain operably coupled to a wild-type albumin, or mutant or fragment thereof, which is operably coupled to a second wild-type, human RNase1 domain. In one embodiment, the hybrid nuclease-albumin molecule comprises a VK3LP leader, followed by a first wild-type, human RNase1 domain operably coupled to the N-terminus of wild-type HSA, or a variant or fragment thereof, and a second wild-type, human RNase1 domain operably coupled to the C-terminus of the wild-type HSA, or a variant or fragment thereof (e.g., an RNase-HSA-RNase molecule; RSLV-305; (SEQ ID NO: 22)). In one embodiment, the RNase-HSA-RNase molecule lacks the VK3LP leader (SEQ ID NO: 46).

In some embodiments, a hybrid nuclease-albumin molecule comprises a wild-type, human RNase1 domain operably coupled via a (Gly$_4$Ser)$_n$ (SEQ ID NO: 141) linker to a wild-type albumin, or mutant or fragment thereof, which is operably coupled via a (Gly$_4$Ser)$_n$ (SEQ ID NO: 141) linker to a second wild-type, human RNase1 domain. In one embodiment, the hybrid nuclease-albumin molecule comprises a VK3LP leader, followed by a first wild-type, human RNase1 domain operably coupled via a (Gly$_4$Ser)$_3$ (SEQ ID NO: 85) linker domain to the N-terminus of wild-type HSA, or mutant or fragment thereof, and a second wild-type, human RNase1 domain operably coupled via a (Gly$_4$Ser)$_3$ (SEQ ID NO: 85) linker domain to the C-terminus of the wild-type HSA, or a variant or fragment thereof (e.g., an RNase-linker-HSA-linker-RNase molecule; RSLV-306; (SEQ ID NO: 23)). In one embodiment, the RNase-linker-HSA-linker-RNase molecule lacks the VK3LP leader (SEQ ID NO: 47).

In some embodiments, a hybrid nuclease-albumin molecule comprises a wild-type, human RNase1 domain operably coupled to a wild-type albumin, or mutant or fragment thereof, which is operably coupled to a mutant, human DNase1 domain. In one embodiment, the hybrid nuclease-albumin molecule comprises a VK3LP leader, followed by a wild-type, human RNase1 domain operably coupled to the N-terminus of wild-type HSA, or a variant or fragment thereof, and the mutant, human DNase1 A114F domain is operably coupled to the C-terminus of the wild-type HSA, or a variant or fragment thereof (e.g., an RNase-HSA-DNase A114F molecule; RSLV-307 (SEQ ID NO: 24)). In one embodiment, the RNase-HSA-DNase A114F molecule lacks the VK3LP leader (SEQ ID NO: 48).

In another embodiment, the hybrid nuclease-albumin molecule comprises a VK3LP leader, followed by a mutant, human DNase1 A114F domain operably coupled to the N-terminus of wild-type HSA, or a variant or fragment thereof, and the wild-type, human RNase domain is operably coupled to the C-terminus of the wild-type HSA, or a variant or fragment thereof (e.g., a DNase A114F-HSA-RNase molecule; RSLV-309 (SEQ ID NO: 26)). In one embodiment, the DNase A114F-HSA-RNase molecule lacks the VK3LP leader (SEQ ID NO: 50).

In some embodiments, a hybrid nuclease-albumin molecule comprises a wild-type, human RNase1 domain operably coupled via a (Gly$_4$Ser)$_n$ (SEQ ID NO: 141) linker domain to a wild-type albumin, or mutant or fragment thereof, which is operably coupled via a (Gly$_4$Ser)$_n$ (SEQ ID NO: 141) linker domain to a mutant, human DNase1 domain. In one embodiment, the hybrid nuclease-albumin molecule comprises a VK3LP leader, followed by a wild-type, human RNase1 domain is operably coupled via a (Gly$_4$Ser)$_3$ (SEQ ID NO: 85) linker domain to the N-terminus of wild-type HSA, or a variant or fragment thereof, and the mutant, DNase A114F domain is operably coupled via a (Gly$_4$Ser)$_3$ (SEQ ID NO: 85) linker domain to the C-terminus of the wild-type HSA, or a variant or fragment thereof (e.g., an RNase-linker-HSA-linker-DNase A114F molecule; RSLV-308 (SEQ ID NO: 25)). In one embodiment, the RNase-linker-HSA-linker-DNase A114F molecule lacks the VK3LP leader (SEQ ID NO: 49).

In another embodiment, the hybrid nuclease-albumin molecule comprises a VK3LP leader, followed by a mutant, DNase1 A114F domain is operably coupled via a (Gly$_4$Ser)$_3$ (SEQ ID NO: 85) linker domain to the N-terminus of wild-type HSA, or a variant or fragment thereof, and a wild-type, human RNase1 domain operably coupled via a (Gly$_4$Ser)$_3$ (SEQ ID NO: 85) linker domain to the C-terminus to the wild-type HSA, or a variant or fragment thereof (e.g., a DNase1 A114F-linker-HSA-linker-RNase1 molecule; RSLV-310 (SEQ ID NO: 27)). In one embodiment, the DNase1 A114F-linker-HSA-linker-RNase1 molecule lacks the VK3LP leader (SEQ ID NO: 51).

In some embodiments, a hybrid nuclease-albumin molecule comprises a mutant, human DNase1 domain operably coupled to a wild-type albumin, or mutant or fragment thereof. In one embodiment, the hybrid nuclease-albumin molecule comprises a VK3LP leader, followed by a mutant, human DNase1 A114F domain operably coupled to the N-terminus of wild-type HSA, or a variant or fragment thereof (e.g., a DNase A114F-HSA molecule; RSLV-311 (SEQ ID NO: 28)). In one embodiment, the DNase A114F-HSA molecule lacks the VK3LP leader (SEQ ID NO: 52).

In another embodiment, the hybrid nuclease-albumin molecule comprises a VK3LP leader, followed by a wild-type HSA, or a variant of fragment thereof operably coupled at its C-terminus to a mutant, human DNase1 A114F (e.g., an HSA-DNase A114F molecule; RSLV-312 (SEQ ID NO: 29)). In one embodiment, the HSA-DNase A114F molecule lacks the VK3LP leader (SEQ ID NO: 53).

In some embodiments, a hybrid nuclease-albumin molecule comprises a mutant, human DNase1 domain operably coupled via a (Gly$_4$Ser)$_n$ (SEQ ID NO: 141) linker domain to a wild-type albumin, or a variant or fragment thereof. In one embodiment, the hybrid nuclease-albumin molecule comprises a VK3LP leader, followed by a mutant, human DNase1 A114F domain operably coupled via a (Gly$_4$Ser)$_3$ (SEQ ID NO: 85) linker domain to the N-terminus of wild-type HSA, or a variant or fragment thereof (e.g., a DNase A114F-linker-HSA molecule; RSLV-313 (SEQ ID NO: 30)). In one embodiment, the DNase A114F-linker-HSA molecule lacks the VK3LP leader (SEQ ID NO: 54).

In another embodiment, the hybrid nuclease-albumin molecule comprises a VK3LP leader, followed by a wild-type HSA, or a variant or fragment thereof, operably coupled at its C-terminus via a (Gly$_4$Ser)$_3$ (SEQ ID NO: 85) linker to a mutant human DNase1 (e.g., an HSA-linker-DNase A114F molecule; RSLV-314 (SEQ ID NO: 31). In one embodiment, the HSA-linker-DNase A114F molecule lacks the VK3LP leader (SEQ ID NO: 55).

In some embodiments, the hybrid nuclease-albumin molecule is aglycosylated and comprises a mutant, human RNase1 domain operably coupled via a (Gly$_4$Ser)$_n$ (SEQ ID NO: 141) linker to a wild-type albumin, or mutant or fragment thereof. In one embodiment, the aglycosylated hybrid nuclease-albumin molecule comprises a VK3LP leader, followed by a mutant, human RNase1 N34S/N76S/N88S domain operably coupled via a (Gly4Ser)3 (SEQ ID NO: 85) linker to the N-terminus of a wild-type HSA, or variant or fragment thereof (e.g., an RNase1 N34S/N76S/N88S-linker-HSA molecule; RSLV-315 (SEQ ID NO: 32). In one embodiment, the RNase1 N34S/N76S/N88S-linker-HSA molecule lacks the VK3LP leader (SEQ ID NO: 56).

In another embodiment, the aglycosylated hybrid nuclease-albumin molecule comprises a VK3LP leader, followed by a by wild-type HSA, or a variant or fragment thereof, operably coupled at its C-terminus via a (Gly$_4$Ser)$_3$ (SEQ ID NO: 85) linker to a mutant, human RNase1 N34S/N76S/N88S domain. (e.g., an HSA-linker-RNase1 N34S/N76S/N88S molecule; RSLV-316 (SEQ ID NO: 33). In one embodiment, the HSA-linker-RNase1 N34S/N76S/N88S molecule lacks the VK3LP leader (SEQ ID NO: 57).

In some embodiments, an aglycosylated hybrid nuclease-albumin molecule comprises a mutant, human DNase1 domain operably coupled via a (Gly$_4$Ser)$_n$ (SEQ ID NO: 141) linker to a wild-type albumin, or mutant or fragment thereof. In one embodiment, the aglycosylated hybrid nuclease-albumin molecule comprises a VK3LP leader, followed by mutant, human DNase1 N18S/N106S/A114F domain operably coupled via a (Gly$_4$Ser)$_3$ (SEQ ID NO: 85) linker to the N-terminus of a wild-type HSA, or variant or fragment thereof (e.g., an DNase1 N18S/N106S/A114F-linker-HSA molecule; RSLV-317 (SEQ ID NO: 34). In one embodiment, the DNase1 N18S/N106S/A114F-linker-HSA molecule lacks the VK3LP leader (SEQ ID NO: 58).

In another embodiment, the aglycosylated hybrid nuclease-albumin molecule comprises a VK3LP leader, followed by wild-type HSA, or a variant or fragment thereof operably coupled at its C-terminus via a (Gly$_4$Ser)$_3$ (SEQ ID NO: 85) linker to a mutant, human DNase1 N18S/N106S/A114F domain (e.g., an HSA-linker-DNase1 N18S/N106S/A114F molecule; RSLV-318 (SEQ ID NO: 35). In one embodiment, the HSA-linker-DNase1 N18S/N106S/A114F molecule lacks the VK3LP leader (SEQ ID NO: 59).

In some embodiments, an aglycosylated hybrid nuclease-albumin molecule comprises a mutant, human RNase1 domain operably coupled via a (Gly$_4$Ser)$_n$ (SEQ ID NO: 141) linker to a wild-type albumin, or mutant or fragment thereof, which is operably coupled via a (Gly$_4$Ser)$_n$ (SEQ ID NO: 141) linker to a mutant, human DNase1 domain. In one embodiment, the aglycosylated hybrid nuclease-albumin molecule comprises a VK3LP leader, followed by a mutant, human RNase1 N34S/N76S/N88S domain operably coupled via a (Gly$_4$Ser)$_3$ (SEQ ID NO: 85) linker to the N-terminus of a wild-type HSA, or variant or fragment thereof, and a mutant, DNase A114F domain operably coupled via a (Gly$_4$Ser)$_3$ (SEQ ID NO: 85) linker to the C-terminus of the wild-type HSA, or variant or fragment thereof (e.g., an RNase1 N34S/N76S/N88S-linker-HSA-linker-DNase1 A114F molecule; RSLV-319 (SEQ ID NO: 36). In some embodiments, the RNase1 N34S/N76S/N88S-linker-HSA-linker-DNase1 A114F molecule lacks the VK3LP leader (SEQ ID NO: 60).

In another embodiment, the aglycosylated hybrid nuclease-albumin molecule comprises a VK3LP leader, followed by a mutant, DNase A114F domain operably coupled via a (Gly$_4$Ser)$_3$ linker to the N-terminus of a wild-type HSA, or variant or fragment thereof, and a mutant, human RNase1 N34S/N76S/N88S domain operably coupled via a (Gly$_4$Ser)$_3$ (SEQ ID NO: 85) linker to the C-terminus of the wild-type HSA, or variant or fragment thereof (e.g., a DNase1 A114F-linker-HSA-linker-RNase1 N34S/N76S/N88S molecule; RSLV-320 (SEQ ID NO: 37). In some embodiments, the DNase1 A114F-linker-HSA-linker-RNase1 N34S/N76S/N88S molecule lacks the VK3LP leader (SEQ ID NO: 61).

In another embodiment, the aglycosylated hybrid nuclease-albumin molecule comprises a VK3LP leader, followed by mutant, human RNase1 N34S/N76S/N88S domain operably coupled via a (Gly$_4$Ser)$_3$ (SEQ ID NO: 85) linker to the N-terminus of a wild-type HSA, or variant or fragment thereof, and a mutant, DNase N18S/N106S/A114F domain operably coupled via a (Gly$_4$Ser)$_3$ (SEQ ID NO: 85) linker to the C-terminus of the wild-type HSA, or variant or fragment thereof (e.g., an RNase1 N34S/N76S/N88S-linker-HSA-linker-DNase1 N18S/N106S/A114F molecule; RSLV-321 (SEQ ID NO: 38). In some embodiments, the RNase1 N34S/N76S/N88S-linker-HSA-linker-DNase1 N18S/N106S/A114F molecule lacks the VK3LP leader (SEQ ID NO: 62).

In another embodiment, the aglycosylated hybrid nuclease-albumin molecule comprises a VK3LP leader, followed by a mutant, DNase N18S/N106S/A114F domain operably coupled via a (Gly$_4$Ser)$_3$ (SEQ ID NO: 85) linker to the N-terminus of a wild-type HSA, or variant or fragment thereof, and a mutant, human RNase1 N34S/N76S/N88S domain operably coupled via a (Gly$_4$Ser)$_3$ (SEQ ID NO: 85) linker to the C-terminus of the wild-type HSA, or variant or fragment thereof (e.g., a DNase1 N18S/N106S/A114F-linker-HSA-linker-RNase1 N34S/N76S/N88S molecule; RSLV-322 (SEQ ID NO: 39). In some embodiments, the DNase1 N18S/N106S/A114F-linker-HSA-linker-RNase1 N34S/N76S/N88S molecule lacks the VK3LP leader (SEQ ID NO: 63).

In some embodiments, a hybrid nuclease-albumin molecule comprises a mutant, DNase1 A114F domain operably coupled via a (Gly$_4$Ser)$_n$ (SEQ ID NO: 141) linker domain to a wild-type, human RNase1 domain, which is operably coupled to a wild-type albumin, or mutant or fragment thereof. In one embodiment, a mutant, human DNase1 A114F domain is operably coupled via a (Gly$_4$Ser)$_3$ (SEQ ID NO: 85) linker domain to a wild-type, human RNase1 domain, and the wild-type, human RNase1 domain is operably coupled to the N-terminus of a wild-type HSA, or mutant or fragment thereof (e.g., a DNase A114F-linker-RNase-HSA molecule; RSLV-323 (SEQ ID NO: 40)). In some embodiments, the DNase A114F-linker-RNase-HSA molecule lacks the VK3LP leader (SEQ ID NO: 64).

In another embodiment, a wild-type, human RNase1 domain is operably coupled to the C-terminus of a wild-type HSA comprising a VK3LP leader sequence, or mutant or fragment thereof, and a mutant, human DNase1 A114F domain further operably coupled via a (Gly$_4$Ser)$_3$ (SEQ ID NO: 85) linker domain to the wild-type, human RNase1 domain (e.g., an HSA-RNase-linker-DNase A114F molecule; RSLV-324 (SEQ ID NO: 41)). In some embodiments, the HSA-RNase-linker-DNase A114F molecule lacks the VK3LP leader (SEQ ID NO: 65).

In some embodiments, a hybrid nuclease-albumin molecule comprises a mutant, human DNase1 domain operably coupled via a (Gly$_4$Ser)$_n$ (SEQ ID NO: 141) linker to a wild-type albumin (HSA), or mutant fragment thereof. In one embodiment, the hybrid nuclease-album molecule comprises a VK3LP leader, followed by wild-type HSA, or a variant or fragment thereof operably coupled at its C-terminus via a (Gly$_4$Ser)$_3$ (SEQ ID NO: 85) linker to a mutant human DNase1 E13R/N74K/A114F/T205K domain (e.g., an HSA-linker-DNase1 E13R/N74K/A114F/T205K molecule; RSLV-325 (SEQ ID NO:110). In one embodiment, the HSA-linker-DNase1 E13R/N74K/A114F/T205K molecule lacks the VK3LP leader (SEQ ID NO:118).

In another embodiment, the hybrid nuclease-albumin molecule comprises a VK3LP leader, followed by mutant human DNase1 E13R/N74K/A114F/T205K domain operably coupled via a (Gly$_4$Ser)$_3$ (SEQ ID NO: 85) linker to the N-terminus of wild-type HSA, or a variant or fragment thereof (e.g., DNase1 E13R/N74K/A114F/T205K-linker-HSA molecule; RSLV-326 (SEQ ID NO:111). In one embodiment, the DNase1 E13R/N74K/A114F/T205K-linker-HSA molecule lacks the VK3LP leader (SEQ ID NO:119).

In some embodiments, a hybrid nuclease-albumin molecule comprises a wild-type, human RNase1 domain operably coupled via a (Gly$_4$Ser)$_n$ (SEQ ID NO: 141) linker domain to a wild-type albumin, or mutant or fragment thereof, which is operably coupled via a (Gly$_4$Ser)$_n$ (SEQ ID NO: 141) linker domain to a mutant, human DNase1 domain. In one embodiment, the hybrid nuclease-album molecule comprises a VK3LP leader, followed by a wild-type, human RNase1 domain operably coupled via a (Gly$_4$Ser)$_3$ (SEQ ID NO: 85) linker domain to the N-terminus of wild-type HSA, or a variant or fragment thereof, and the mutant human DNase1 E13R/N74K/A114F/T205K domain is operably coupled via a (Gly$_4$Ser)$_3$ (SEQ ID NO: 85) linker domain to the C-terminus of wild-type HSA, or a variant or fragment thereof. (e.g., an RNase1-linker-HSA-linker-DNase1 E13R/N74K/A114F/T205K molecule;

RSLV-327 (SEQ ID NO:112). In one embodiment, the RNase1-linker-HSA-linker-DNase1 E13R/N74K/A114F/T205K molecule lacks the VK3LP leader (SEQ ID NO:120).

In another embodiment, the hybrid nuclease-albumin molecule comprises a VK3LP leader, followed by mutant human DNase1 E13R/N74K/A114F/T205K domain operably coupled via a (Gly$_4$Ser)$_3$ (SEQ ID NO: 85) linker to the N-terminus of wild-type HSA, or a variant or fragment thereof, and a wild-type, human RNase1 domain operably coupled via a (Gly$_4$Ser)$_3$ (SEQ ID NO: 85) linker domain to the C-terminus of the wild-type HSA, or a variant or fragment thereof (e.g., DNase1 E13R/N74K/A114F/T205K-linker-HSA-linker-RNase1 molecule; RSLV-328 (SEQ ID NO:113). In one embodiment, the DNase1 E13R/N74K/A114F/T205K-linker-HSA-linker-RNase1 molecule lacks the VK3LP leader (SEQ ID NO:121).

In some embodiments, the hybrid nuclease-albumin molecule comprises a VK3LP leader, followed by a RNase1 is operably coupled via a (Gly$_4$Ser)$_3$ (SEQ ID NO: 85) sequence to a wild-type HSA, and wherein the wild-type human HSA is operably coupled via a NLG sequence to a DNase1 E13R/N74K/A114F/T205K domain (e.g., an RNase1-(Gly$_4$Ser)$_3$ (SEQ ID NO: 85)-HSA-NLG-DNase1 E13R/N74K/A114F/T205K molecule; RSLV-329 (SEQ ID NO: 114). In one embodiment, the RNase1-(Gly$_4$Ser)$_3$ (SEQ ID NO: 85)-HSA-NLG-DNase1 E13R/N74K/A114F/T205K molecule lacks the VK3LP leader (SEQ ID NO: 122). RSLV-329 has an NLG linker connecting DNase to the HSA.

In another embodiment, the aglycosylated hybrid nuclease-albumin molecule comprises a VK3LP leader, followed by mutant human DNase1 E13R/N74K/A114F/T205K/N18S/N106S domain operably coupled via a (Gly$_4$Ser)$_3$ (SEQ ID NO: 85) linker to the N-terminus of wild-type HSA, or a variant or fragment thereof (e.g., DNase1 E13R/N74K/A114F/T205K/N18S/N106S-linker-HSA molecule; RSLV-330 (SEQ ID NO:115). In one embodiment, the DNase1 E13R/N74K/A114F/T205K/N18S/N106S-linker-HSA molecule lacks the VK3LP leader (SEQ ID NO:123).

In some embodiments, an aglycosylated hybrid nuclease-albumin molecule comprises a wild-type, human RNase1 domain operably coupled via a (Gly$_4$Ser)$_n$ (SEQ ID NO: 141) linker domain to a wild-type albumin, or mutant or fragment thereof, which is operably coupled via a (Gly$_4$Ser)n (SEQ ID NO: 141) linker domain to a mutant, human DNase1 domain. In one embodiment, the aglycosylated hybrid nuclease-album molecule comprises a VK3LP leader, followed by a wild-type, human RNase1 domain operably coupled via a (Gly$_4$Ser)$_3$ (SEQ ID NO: 85) linker domain to the N-terminus of wild-type HSA, or a variant or fragment thereof, and the mutant human DNase1 E13R/N74K/A114F/T205K/N18S/N106S domain is operably coupled via a (Gly$_4$Ser)$_3$ (SEQ ID NO: 85) linker domain to the C-terminus of wild-type HSA, or a variant or fragment thereof. (e.g., an RNase1-linker-HSA-linker-DNase1 E13R/N74K/A114F/T205K/N18S/N106S molecule; RSLV-331 (SEQ ID NO:116). In one embodiment, the RNase1-linker-HSA-linker-DNase1 E13R/N74K/A114F/T205K/N18S/N106S molecule lacks the VK3LP leader (SEQ ID NO:124).

In another embodiment, the aglycosylated hybrid nuclease-albumin molecule comprises a VK3LP leader, followed by mutant human DNase1 E13R/N74K/A114F/T205K/N18S/N106S domain operably coupled via a (Gly4Ser)$_3$ (SEQ ID NO: 85) linker to the N-terminus of wild-type HSA, or a variant or fragment thereof, and a wild-type, human RNase1 domain operably coupled via a (Gly4Ser)$_3$ (SEQ ID NO: 85) linker domain to the C-terminus of the wild-type HSA, or a variant or fragment thereof (e.g., DNase1 E13R/N74K/A114F/T205K/N18S/N106S-linker-HSA-linker-RNase1 molecule; RSLV-332 (SEQ ID NO: 117). In one embodiment, the DNase1 E13R/N74K/A114F/T205K/N18S/N106S-linker-HSA-linker-RNase1 molecule lacks the VK3LP leader (SEQ ID NO:125).

In some embodiments, an aglycosylated hybrid nuclease-albumin molecule comprises a mutant, human DNase1 domain operably coupled via a (Gly$_4$Ser)$_n$ (SEQ ID NO: 141) linker to a wild-type albumin, or mutant fragment thereof. In one embodiment, the aglycosylated hybrid nuclease-album molecule comprises a VK3LP leader, followed by wild-type HSA, or a variant or fragment thereof operably coupled at its C-terminus via a (Gly$_4$Ser)$_3$ (SEQ ID NO: 85) linker to a mutant human DNase1 E13R/N74K/A114F/T205K/N18S/N106S domain (e.g., an HSA-linker-DNase1 E13R/N74K/A114F/T205K/N18S/N106S molecule). In one embodiment, the HSA-linker-DNase1 E13R/N74K/A114F/T205K/N18S/N106S molecule lacks the VK3LP leader (SEQ ID NO:138).

In some embodiments, a hybrid nuclease-albumin molecule has an amino acid sequence at least 80% identical, such as 85%, 90%, 91%, 92%, 93%, 94%, 95%, 96%, 97%, 98%, 99%, or at least 99.5% identical to an amino acid sequence of any one of SEQ ID NOs: 18-65.

It will be understood by one of ordinary skill that the leader and linker sequences are optional and are not limited to those described in the embodiments above. For example, the RNase and/or DNase domains can be directly fused to the N- and/or C-terminus of HSA, or variant or fragment thereof; the leader domain can be any of those known in the art to be useful for its intended purpose, e.g., to increase protein expression and/or secretion (e.g., a *Gaussia* luciferase signal peptide (MGVKVLFALICIAVAEA; SEQ ID NO: 87)); the linker can be any linker known in the art, e.g., (Gly$_4$Ser)$_n$, NLG (VDGAAASPVNVSSPSVQDI; SEQ ID NO: 88), LE, thrombin-sensitive disulphide cyclopeptide linker, LEA(EAAAK)$_4$ALEA(EAAAK)$_4$ (SEQ ID NO: 80), or an in vivo cleavable disulphide linker, as described herein. It will also be understood that it is within the abilities of a skilled artisan to make the corresponding changes to the amino acid sequences of the hybrid nuclease molecule using routine cloning and recombination methods. It will also be understood that the asparagine residues in the nuclease domains (i.e., N34, N76, and N88 in RNase1, and N18 and N106 in DNase1) can be substituted with an amino acid other than serine (e.g., glutamine), as long as the amino acid does not serve as an acceptor for N-linked glycosylation.

Methods of Making Hybrid Nuclease-Albumin Molecules

The hybrid nuclease-albumin molecules of this invention largely may be made in transformed or transfected host cells using recombinant DNA techniques. To do so, a recombinant DNA molecule coding for the peptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidate method. Also, a combination of these techniques could be used.

The invention also includes a vector capable of expressing the peptides in an appropriate host. The vector comprises the DNA molecule that codes for the peptides operably coupled to appropriate expression control sequences. Methods of affecting this operative linking, either before or after the DNA molecule is inserted into the vector, are well known. Expression control sequences include promoters, activators, enhancers, operators, ribosomal nuclease domains, start signals, stop signals, cap signals, polyadenylation signals, and other signals involved with the control of transcription or translation.

The resulting vector having the DNA molecule thereon is used to transform or transfect an appropriate host. This transformation or transfection may be performed using methods well known in the art.

Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation or transfection, ease of recovery of the peptides, expression characteristics, bio-safety and costs. A balance of these factors must be struck with the understanding that not all hosts may be equally effective for the expression of a particular DNA sequence. Within these general guidelines, useful microbial hosts include bacteria (such as *E. coli*), yeast (such as *Saccharomyces*) and other fungi, insects, plants, mammalian (including human) cells in culture, or other hosts known in the art. In a preferred embodiment, the hybrid nuclease-albumin molecules are produced in CHO cells.

Next, the transformed or transfected host is cultured and purified. Host cells may be cultured under conventional fermentation or culture conditions so that the desired compounds are expressed. Such fermentation and culture conditions are well known in the art. Finally, the peptides are purified from culture by methods well known in the art.

The compounds may also be made by synthetic methods. For example, solid phase synthesis techniques may be used. Suitable techniques are well known in the art, and include those described in Merrifield (1973), Chem. Polypeptides, pp. 335-61 (Katsoyannis and Panayotis eds.); Merrifield (1963), J. Am. Chem. Soc. 85: 2149; Davis et al., *Biochem Intl* 1985; 10: 394-414; Stewart and Young (1969), Solid Phase Peptide Synthesis; U.S. Pat. No. 3,941,763; Finn et al. (1976), The Proteins (3rd ed.) 2: 105-253; and Erickson et al. (1976), The Proteins (3rd ed.) 2: 257-527. Solid phase synthesis is the preferred technique of making individual peptides since it is the most cost-effective method of making small peptides. Compounds that contain derivatized peptides or which contain non-peptide groups may be synthesized by well-known organic chemistry techniques.

Other methods are of molecule expression/synthesis are generally known in the art to one of ordinary skill.

Hybrid Nuclease-Albumin Molecules with Altered Glycosylation

Glycosylation (e.g., O-linked or N-linked glycosylation) can impact the serum half-life of the hybrid nuclease-albumin molecules of the invention by, e.g., minimizing their removal from circulation by mannose and asialoglycoprotein receptors and other lectin-like receptors. Accordingly, in some embodiments, the hybrid nuclease-albumin molecules of the invention are prepared in aglycosylated, deglycosylated, or underglycosylated form. Preferably, N-linked glycosylation is altered and the hybrid nuclease-albumin molecule is glycosylated.

In some embodiments, all asparagine residues in a hybrid nuclease-albumin molecule that conform to the Asn-X-Ser/Thr (X can be any other naturally occurring amino acid except Pro) consensus are mutated to residues that do not serve as acceptors of N-linked glycosylation (e.g., serine, glutamine), thereby eliminating glycosylation of the hybrid nuclease-albumin molecule when synthesized in a cell that glycosylates proteins.

In some embodiments, hybrid nuclease-albumin molecules lacking N-linked glycosylation sites are produced in mammalian cells. In one embodiment, the mammalian cell is a CHO cell. Accordingly, in a specific embodiment, an aglycosylated hybrid nuclease-albumin molecule is produced in a CHO cell.

In other embodiments, a reduction or lack of N-glycosylation is achieved by, e.g., producing hybrid nuclease-albumin molecules in a host (e.g., bacteria such as *E. coli*), mammalian cells engineered to lack one or more enzymes important for glycosylation, or mammalian cells treated with agents that prevent glycosylation, such as tunicamycin (an inhibitor of Dol-PP-GlcNAc formation).

In some embodiments, the hybrid nuclease-albumin molecules are produced in lower eukaryotes engineered to produce glycoproteins with complex N-glycans, rather than high mannose type sugars (see, e.g., US2007/0105127).

In some embodiments, glycosylated hybrid nuclease-albumin molecules (e.g., those produced in mammalian cells such as CHO cells) are treated chemically or enzymatically to remove one or more carbohydrate residues (e.g., one or more mannose, fucose, and/or N-acetylglucosamine residues) or to modify or mask one or more carbohydrate residues. Such modifications or masking may reduce binding of the hybrid nuclease-albumin molecules to mannose receptors, and/or asialoglycoprotein receptors, and/or other lectin-like receptors. Chemical deglycosylation can be achieved by treating a hybrid nuclease-albumin molecule with trifluoromethane sulfonic acid (TFMS), as disclosed in, e.g., Sojar et al., *JBC* 1989; 264:2552-9 and Sojar et al., *Methods Enzymol* 1987; 138:341-50, or by treating with hydrogen fluoride, as disclosed in Sojar et al. (1987, supra). Enzymatic removal of N-linked carbohydrates from hybrid nuclease-albumin molecules can be achieved by treating a hybrid nuclease-albumin molecule with protein N-glycosidase (PNGase) A or F, as disclosed in Thotakura et al. (*Methods Enzymol* 1987; 138:350-9). Other art-recognized commercially available deglycosylating enzymes that are suitable for use include endo-alpha-N-acetyl-galactosaminidase, endoglycosidase F1, endoglycosidase F2, endoglycosidase F3, and endoglycosidase H. In some embodiments, one or more of these enzymes can be used to deglycosylate the hybrid nuclease-albumin molecules of the invention. Alternative methods for deglycosylation are disclosed in, e.g., U.S. Pat. No. 8,198,063.

In some embodiments, the hybrid nuclease-albumin molecules are partially deglycosylated. Partial deglycosylation can be achieved by treating the hybrid nuclease-albumin molecules with an endoglycosidase (e.g., endoglycosidase H), which cleaves N-linked high mannose carbohydrate but not complex type carbohydrates, leaving a single GlcNAc residue linked to the asparagine. Hybrid nuclease-albumin molecules treated with endoglycosidase H will lack high mannose carbohydrates, resulting in a reduced interaction with the hepatic mannose receptor. Although this receptor recognizes terminal GlcNAc, the probability of a productive interaction with the single GlcNAc on the protein surface is not as great as with an intact high mannose structure.

In other embodiments, glycosylation of a hybrid nuclease-albumin molecule is modified, e.g., by oxidation, reduction, dehydration, substitution, esterification, alkylation, sialylation, carbon-carbon bond cleavage, or the like, to reduce clearance of the hybrid nuclease-albumin molecules from blood. In some embodiments, the hybrid nuclease-albumin molecules are treated with periodate and sodium borohydride to modify the carbohydrate structure. Periodate treatment oxidizes vicinal diols, cleaving the carbon-carbon bond and replacing the hydroxyl groups with aldehyde groups; borohydride reduces the aldehydes to hydroxyls. Many sugar residues include vicinal diols and, therefore, are cleaved by this treatment. Prolonged serum half-life with periodate and sodium borohydride is exemplified by the sequential treatment of the lysosomal enzyme β-glucuronidase with these agents (see, e.g., Houba et al. (1996) *Bioconjug Chem* 1996:7:606-11; Stahl et al. *PNAS* 1976; 73:4045-9; Achord et al. *Pediat. Res* 1977; 11:816-22; Achord et al. *Cell* 1978; 15:269-78). A method for treatment with periodate and sodium borohydride is disclosed in Hickman et al., *BBRC* 1974; 57:55-61. A method for treatment with periodate and cyanoborohydride, which increases the serum half-life and tissue distribution of ricin, is disclosed in Thorpe et al. *Eur Biochem* 1985; 147:197-206.

In one embodiment, the carbohydrate structures of a hybrid nuclease-albumin molecule can be masked by addition of one or more additional moieties (e.g., carbohydrate groups, phosphate groups, alkyl groups, etc.) that interfere with recognition of the structure by a mannose or asialoglycoprotein receptor or other lectin-like receptors.

In some embodiments, one or more potential glycosylation sites are removed by mutation of the nucleic acid encoding the hybrid nuclease-albumin molecule, thereby reducing glycosylation (underglycosylation) of the hybrid nuclease-albumin molecule when synthesized in a cell that glycosylates proteins, e.g., a mammalian cell such as a CHO cell. In some embodiments, it may be desirable to selectively underglycosylate the nuclease domain of the hybrid nuclease-albumin molecules by mutating the potential N-linked glycosylation sites therein if, e.g., the underglycosylated hybrid nuclease-albumin molecule exhibits increased activity or contributes to increased serum half-life. In other embodiments, it may be desirable to underglycosylate portions of the hybrid nuclease-albumin molecule such that regions other than the nuclease domain lack N-glycosylation if, for example, such a modification improves the serum half-life of the hybrid nuclease-albumin molecule. Alternatively, other amino acids in the vicinity of glycosylation acceptors can be modified, disrupting a recognition motif for glycosylation enzymes without necessarily changing the amino acid that would normally be glycosylated.

In some embodiments, glycosylation of a hybrid nuclease-albumin molecule can be altered by introducing glycosylation sites. For example, the amino acid sequence of the hybrid nuclease-albumin molecule can be modified to introduce the consensus sequence for N-linked glycosylation of Asp-X-Ser/Thr (X is any amino acid other than proline). Additional N-linked glycosylation sites can be added anywhere throughout the amino acid sequence of the hybrid nuclease-albumin molecule. Preferably, the glycosylation sites are introduced in position in the amino acid sequence that does not substantially reduce the nuclease (e.g., RNase and/or DNase) activity of the hybrid nuclease-albumin molecule.

The addition of O-linked glycosylation sites has been reported to alter serum half-life of proteins, such as growth hormone, follicle-stimulating hormone, IGFBP-6, Factor IX, and many others (e.g., as disclosed in Okada et al., *Endocr Rev* 2011; 32:2-342; Weenen et al., *J Clin Endocrinol Metab* 2004; 89:5204-12; Marinaro et al., *European Journal of Endocrinology* 2000; 142:512-6; US 2011/ 0154516). Accordingly, in some embodiments, O-linked glycosylation (on serine/threonine residues) of the hybrid nuclease-albumin molecules is altered. Methods for altering O-linked glycosylation are routine in the art and can be achieved, e.g., by beta-elimination (see, e.g., Huang et al., *Rapid Communications in Mass Spectrometry* 2002; 16:1199-204; Conrad, *Curr Protoc Mol Biol* 2001; Chapter 17:Unit 17.15A; Fukuda, *Curr Protoc Mol Biol* 2001; Chapter 17; Unit 17.15B; Zachara et al., *Curr Protoc Mol Biol* 2011; Unit 17.6;); by using commercially available kits (e.g., GlycoProfile™ Beta-Elimination Kit, Sigma); or by subjecting the hybrid nuclease-albumin molecule to treatment with a series of exoglycosidases such as, but not limited to, β1-4 galactosidase and β-N-acetylglucosaminidase, until only Gal β1-3GalNAc and/or GlcNAc β1-3GalNAc remains, followed by treatment with, e.g., endo-α-N-acetylgalactosaminidase (i.e., O-glycosidase). Such enzymes are commercially available from, e.g., New England Biolabs. In yet other embodiments, the hybrid nuclease-albumin molecules are altered to introduce O-linked glycosylation in the hybrid nuclease-albumin molecule as disclosed in, e.g., Okada et al. (supra), Weenen et al. (supra), US2008/0274958; and US2011/0171218. In some embodiments, one or more O-linked glycosylation consensus sites are introduced into the hybrid nuclease-albumin molecule, such as CXXGGT/ S-C(SEQ ID NO: 101) (van den Steen et al., In *Critical Reviews in Biochemistry and Molecular Biology*, Michael Cox, ed., 1998; 33:151-208), NST-E/D-A (SEQ ID NO: 102), NITQS (SEQ ID NO: 103), QSTQS (SEQ ID NO: 104), D/EFT-R/K-V (SEQ ID NO: 105), C-E/D-SN (SEQ ID NO: 106), and GGSC-K/R (SEQ ID NO: 107). Additional O-linked glycosylation sites can be added anywhere throughout the amino acid sequence of the hybrid nuclease-albumin molecule. Preferably, the glycosylation sites are introduced in position in the amino acid sequence that does not substantially reduce the nuclease (e.g., RNase and/or DNase) activity of the hybrid nuclease-albumin molecule. Alternatively, O-linked sugar moieties are introduced by chemically modifying an amino acid in the hybrid nuclease-albumin molecule as described in, e.g., WO 87/05330 and Aplin et al., *CRC Crit Rev Biochem* 1981; 259-306).

In some embodiments, both N-linked and O-linked glycosylation sites are introduced into the hybrid nuclease-albumin molecules, preferably in positions in the amino acid sequence that do not substantially reduce the nuclease (e.g., RNase and/or DNase) activity of the hybrid nuclease-albumin molecule.

It is well within the abilities of the skilled artisan to introduce, reduce, or eliminate glycosylation (e.g., N-linked or O-linked glycosylation) in a hybrid nuclease-albumin molecule and determine using routine methods in the art whether such modifications in glycosylation status increases or decreases the nuclease activity or serum half-life of the hybrid nuclease-albumin molecule.

In some embodiments, the hybrid nuclease-albumin molecule may comprise an altered glycoform (e.g., an underfucosylated or fucose-free glycan).

In some embodiments, a hybrid nuclease-albumin molecule with altered glycosylation has a serum half-life that is increased at least about 1.5-fold, such as at least 3-fold, at least 5-fold, at least 10-fold, at least about 20-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1000-fold, or 1000-fold or greater relative to the corresponding glycosylated hybrid nuclease-albumin molecules (e.g., a hybrid nuclease-albumin molecule in which potential N-linked glycosylation sites are not mutated).

Routine art-recognized methods can be used to determine the serum half-life of hybrid nuclease-albumin molecules with altered glycosylation status.

In some embodiments, a hybrid nuclease-albumin molecule with altered glycosylation (e.g., a aglycosylated, deglycosylated, or underglycosylated hybrid nuclease-albumin molecules) retains at least 50%, such as at least 60%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% of the activity of the corresponding glycosylated hybrid nuclease-albumin molecule (e.g., a hybrid nuclease-albumin molecule in which potential N-linked glycosylation sites are not mutated).

In some embodiments, altering the glycosylation status of the hybrid nuclease-albumin molecules may increase nuclease activity, either by directly increasing enzymatic activity, or by increasing bioavailability (e.g., serum half-life). Accordingly, in some embodiments, the nuclease activity of a hybrid nuclease-albumin molecule with altered glycosylation is increased by at least 1.3-fold, such as at least 1.5-fold, at least 2-fold, at least 2.5-fold, at least 3-fold, at least 3.5-fold, at least 4-fold, at least 4.5-fold, at least 5-fold, at least 5.5-fold, at least 6-fold, at least 6.5-fold, at least 7-fold, at least 7.5-fold, at least 8-fold, at least 8.5-fold, at least 9-fold, at least 9.5 fold, or 10-fold or greater, relative to the corresponding glycosylated hybrid nuclease-albumin molecules (e.g., a hybrid nuclease-albumin molecule in which potential N-linked glycosylation sites are not mutated).

The skilled artisan can readily determine the glycosylation status of hybrid nuclease-albumin molecules using art-recognized methods. In a preferred embodiment, the glycosylation status is determined using mass spectrometry. In other embodiments, interactions with Concanavalin A (Con A) can be assessed to determine whether a hybrid nuclease-albumin molecule is underglycosylated. An underglycosylated hybrid nuclease-albumin molecule is expected to exhibit reduced binding to CON A-SEPHAROSE™ when compared to the corresponding glycosylated hybrid nuclease-albumin molecule. SDS-PAGE analysis can also be used to compare the mobility of an underglycosylated protein and corresponding glycosylated protein. The underglycosylated protein is expected to have a greater mobility in SDS-PAGE compared to the glycosylated protein. Other suitable art-recognized methods for analyzing protein glycosylation status are disclosed in, e.g., Roth et al., International Journal of Carbohydrate Chemistry 2012; 2012:1-10.

Pharmacokinetics, such as serum half-life, of hybrid nuclease-albumin molecules with different glycosylation status can be assayed using routine methods, e.g., by introducing the hybrid nuclease-albumin molecules in mice, e.g., intravenously, taking blood samples at pre-determined time points, and assaying and comparing levels and/or enzymatic activity of the hybrid nuclease-albumin molecules in the samples.

Pharmaceutical Compositions

In certain embodiments, a hybrid nuclease-albumin molecule is administered alone. In certain embodiments, a hybrid nuclease-albumin molecule is administered prior to the administration of at least one other therapeutic agent. In certain embodiments, a hybrid nuclease-albumin molecule is administered concurrent with the administration of at least one other therapeutic agent. In certain embodiments, a hybrid nuclease-albumin molecule is administered subsequent to the administration of at least one other therapeutic agent. In other embodiments, a hybrid nuclease-albumin molecule is administered prior to the administration of at least one other therapeutic agent. As will be appreciated by one of skill in the art, in some embodiments, the hybrid nuclease-albumin molecule is combined with the other agent/compound. In some embodiments, the hybrid nuclease-albumin molecule and other agent are administered concurrently. In some embodiments, the hybrid nuclease-albumin molecule and other agent are not administered simultaneously, with the hybrid nuclease-albumin molecule being administered before or after the agent is administered. In some embodiments, the subject receives both the hybrid nuclease-albumin molecule and the other agent during a same period of prevention, occurrence of a disorder, and/or period of treatment.

Pharmaceutical compositions of the invention can be administered in combination therapy, i.e., combined with other agents. In certain embodiments, the combination therapy comprises the hybrid nuclease-albumin molecule, in combination with at least one other agent. Agents include, but are not limited to, in vitro synthetically prepared chemical compositions, antibodies, antigen binding regions, and combinations and conjugates thereof. In certain embodiments, an agent can act as an agonist, antagonist, allosteric modulator, or toxin.

In certain embodiments, the invention provides for pharmaceutical compositions comprising a hybrid nuclease-albumin molecule together with a pharmaceutically acceptable diluent, carrier, solubilizer, emulsifier, preservative and/or adjuvant.

In certain embodiments, the invention provides for pharmaceutical compositions comprising a hybrid nuclease-albumin molecule and a therapeutically effective amount of at least one additional therapeutic agent, together with a pharmaceutically acceptable diluent, carrier, solubilizer, emulsifier, preservative and/or adjuvant.

In certain embodiments, acceptable formulation materials preferably are nontoxic to recipients at the dosages and concentrations employed. In some embodiments, the formulation material(s) are for s.c. and/or I.V. administration. In certain embodiments, the pharmaceutical composition can contain formulation materials for modifying, maintaining or preserving, for example, the pH, osmolality, viscosity, clarity, color, isotonicity, odor, sterility, stability, rate of dissolution or release, adsorption or penetration of the composition. In certain embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as gelatin); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. (Remington's Pharmaceutical Sciences, 18th Edition, A. R. Gennaro, ed., Mack Publishing Company (1995). In some embodiments, the formulation comprises PBS; 20 mM NaOAC, pH 5.2, 50 mM NaCl; and/or 10 mM NAOAC, pH 5.2, 9% Sucrose.

In certain embodiments, a hybrid nuclease-albumin molecule and/or a therapeutic molecule is linked to a half-life extending vehicle known in the art. Such vehicles include, but are not limited to, polyethylene glycol, glycogen (e.g., glycosylation of the hybrid nuclease-albumin molecule), and dextran. Such vehicles are described, e.g., in U.S. application Ser. No. 09/428,082, now U.S. Pat. No. 6,660,843 and published PCT Application No. WO 99/25044.

In certain embodiments, the optimal pharmaceutical composition will be determined by one skilled in the art depending upon, for example, the intended route of administration, delivery format and desired dosage. See, for example, Remington's Pharmaceutical Sciences, supra. In certain embodiments, such compositions may influence the physical state, stability, rate of in vivo release and rate of in vivo clearance of the antibodies of the invention.

In certain embodiments, the primary vehicle or carrier in a pharmaceutical composition can be either aqueous or non-aqueous in nature. For example, in certain embodiments, a suitable vehicle or carrier can be water for injection, physiological saline solution or artificial cerebrospinal fluid, possibly supplemented with other materials common in compositions for parenteral administration. In some embodiments, the saline comprises isotonic phosphate-buffered saline. In certain embodiments, neutral buffered saline or saline mixed with serum albumin are further exemplary vehicles. In certain embodiments, pharmaceutical compositions comprise Tris buffer of about pH 7.0-8.5, or acetate buffer of about H 4.0-5.5, which can further include sorbitol or a suitable substitute therefore. In certain embodiments, a composition comprising a hybrid nuclease-albumin molecule, with or without at least one additional therapeutic agents, can be prepared for storage by mixing the selected composition having the desired degree of purity with optional formulation agents (Remington's Pharmaceutical Sciences, supra) in the form of a lyophilized cake or an aqueous solution. Further, in certain embodiments, a composition comprising a hybrid nuclease-albumin molecule, with or without at least one additional therapeutic agent, can be formulated as a lyophilizate using appropriate excipients such as sucrose.

In certain embodiments, the pharmaceutical composition can be selected for parenteral delivery. In certain embodiments, the compositions can be selected for inhalation or for delivery through the digestive tract, such as orally. The preparation of such pharmaceutically acceptable compositions is within the ability of one skilled in the art.

In certain embodiments, the formulation components are present in concentrations that are acceptable to the site of administration. In certain embodiments, buffers are used to maintain the composition at physiological pH or at a slightly lower pH, typically within a pH range of from about 5 to about 8.

In certain embodiments, when parenteral administration is contemplated, a therapeutic composition can be in the form of a pyrogen-free, parenterally acceptable aqueous solution comprising a desired hybrid nuclease-albumin molecule, with or without additional therapeutic agents, in a pharmaceutically acceptable vehicle. In certain embodiments, a vehicle for parenteral injection is sterile distilled water in which a hybrid nuclease-albumin molecule, with or without at least one additional therapeutic agent, is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that can provide for the controlled or sustained release of the product which can then be delivered via a depot injection. In certain embodiments, hyaluronic acid can also be used, and can have the effect of promoting sustained duration in the circulation. In certain embodiments, implantable drug delivery devices can be used to introduce the desired molecule.

In certain embodiments, a pharmaceutical composition can be formulated for inhalation. In certain embodiments, a hybrid nuclease-albumin molecule, with or without at least one additional therapeutic agent, can be formulated as a dry powder for inhalation. In certain embodiments, an inhalation solution comprising a hybrid nuclease-albumin molecule, with or without at least one additional therapeutic agent, can be formulated with a propellant for aerosol delivery. In certain embodiments, solutions can be nebulized. Pulmonary administration is further described in PCT application no. PCT/US94/001875, which describes pulmonary delivery of chemically modified proteins.

In certain embodiments, it is contemplated that formulations can be administered orally. In certain embodiments, a hybrid nuclease-albumin molecule, with or without at least one additional therapeutic agents, that is administered in this fashion can be formulated with or without those carriers customarily used in the compounding of solid dosage forms such as tablets and capsules. In certain embodiments, a capsule can be designed to release the active portion of the formulation at the point in the gastrointestinal tract when bioavailability is maximized and pre-systemic degradation is minimized. In certain embodiments, at least one additional agent can be included to facilitate absorption of a hybrid nuclease-albumin molecule and/or any additional therapeutic agents. In certain embodiments, diluents, flavorings, low melting point waxes, vegetable oils, lubricants, suspending agents, tablet disintegrating agents, and binders can also be employed.

In certain embodiments, a pharmaceutical composition can involve an effective quantity of a hybrid nuclease-albumin molecule, with or without at least one additional therapeutic agents, in a mixture with non-toxic excipients which are suitable for the manufacture of tablets. In certain embodiments, by dissolving the tablets in sterile water, or another appropriate vehicle, solutions can be prepared in unit-dose form. In certain embodiments, suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions will be evident to those skilled in the art, including formulations involving a hybrid nuclease-albumin molecule, with or without at least one additional therapeutic agent(s), in sustained- or controlled-delivery formulations. In certain embodiments, techniques for formulating a variety of other sustained- or controlled-delivery means, such as liposome carriers, bio-erodible microparticles or porous beads and depot injections, are also known to those skilled in the art. See for example, PCT Application No. PCT/US93/00829 which describes the controlled release of porous polymeric microparticles for the delivery of pharmaceutical compositions. In certain embodiments, sustained-release preparations can include semipermeable polymer matrices in the form of shaped articles, e.g. films, or microcapsules. Sustained release matrices can include polyesters, hydrogels, polylactides (U.S. Pat. No. 3,773,919 and EP 058,481), copolymers of L-glutamic acid and gamma ethyl-L-glutamate (Sidman et al, *Biopolymers,* 22:547-556 (1983)), poly (2-hydroxyethyl-methacrylate) (Langer et al., *J Biomed Mater Res,* 15: 167-277 (1981) and Langer, *Chem Tech,* 12:98-105 (1982)), ethylene vinyl acetate (Langer et al, supra) or poly-D(−)-3-hydroxybutyric acid (EP 133,988). In certain embodiments, sustained release compositions can also include liposomes, which can be prepared by any of several methods known in the art. See, e.g., Eppstein et al, *PNAS,* 82:3688-3692 (1985); EP 036,676; EP 088,046 and EP 143,949.

The pharmaceutical composition to be used for in vivo administration typically is sterile. In certain embodiments, this can be accomplished by filtration through sterile filtration membranes. In certain embodiments, where the composition is lyophilized, sterilization using this method can be conducted either prior to or following lyophilization and reconstitution. In certain embodiments, the composition for parenteral administration can be stored in lyophilized form or in a solution. In certain embodiments, parenteral compositions generally are placed into a container having a sterile access port, for example, an intravenous solution bag or vial having a stopper pierceable by a hypodermic injection needle.

In certain embodiments, once the pharmaceutical composition has been formulated, it can be stored in sterile vials as a solution, suspension, gel, emulsion, solid, or as a dehydrated or lyophilized powder. In certain embodiments, such formulations can be stored either in a ready-to-use form or in a form (e.g., lyophilized) that is reconstituted prior to administration.

In certain embodiments, kits are provided for producing a single-dose administration unit. In certain embodiments, the kit can contain both a first container having a dried protein and a second container having an aqueous formulation. In certain embodiments, kits containing single and multi-chambered pre-filled syringes (e.g., liquid syringes and lyosyringes) are included.

In certain embodiments, the effective amount of a pharmaceutical composition comprising a hybrid nuclease-albumin molecule, with or without at least one additional therapeutic agent, to be employed therapeutically will depend, for example, upon the therapeutic context and objectives. One skilled in the art will appreciate that the appropriate dosage levels for treatment, according to certain embodiments, will thus vary depending, in part, upon the molecule delivered, the indication for which a hybrid nuclease-albumin molecule, with or without at least one additional therapeutic agent, is being used, the route of administration, and the size (body weight, body surface or organ size) and/or condition (the age and general health) of the patient. In certain embodiments, the clinician can titer the dosage and modify the route of administration to obtain the optimal therapeutic effect. In certain embodiments, a typical dosage can range from about 0.1 µg/kg to up to about 100 mg/kg or more, depending on the factors mentioned above. In certain embodiments, the dosage can range from 0.1 µg/kg up to about 100 mg/kg; or 1 µg/kg up to about 100 mg/kg; or 5 µg/kg up to about 100 mg/kg.

In certain embodiments, the frequency of dosing will take into account the pharmacokinetic parameters of a hybrid nuclease-albumin molecule and/or any additional therapeutic agents in the formulation used. In certain embodiments, a clinician will administer the composition until a dosage is reached that achieves the desired effect. In certain embodiments, the composition can therefore be administered as a single dose, or as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. In certain embodiments, appropriate dosages can be ascertained through use of appropriate dose-response data.

In certain embodiments, the route of administration of the pharmaceutical composition is in accord with known methods, e.g. orally, through injection by intravenous, intraperitoneal, intracerebral (intra-parenchymal), intracerebroventricular, intramuscular, subcutaneously, intra-ocular, intraarterial, intraportal, or intralesional routes; by sustained release systems or by implantation devices. In certain embodiments, the compositions can be administered by bolus injection or continuously by infusion, or by implantation device.

In certain embodiments, the composition can be administered locally via implantation of a membrane, sponge or another appropriate material onto which the desired molecule has been absorbed or encapsulated. In certain embodiments, where an implantation device is used, the device can be implanted into any suitable tissue or organ, and delivery of the desired molecule can be via diffusion, timed-release bolus, or continuous administration.

In certain embodiments, it can be desirable to use a pharmaceutical composition comprising a hybrid nuclease-albumin molecule, with or without at least one additional therapeutic agent, in an ex vivo manner. In such instances, cells, tissues and/or organs that have been removed from the patient are exposed to a pharmaceutical composition comprising a hybrid nuclease-albumin molecule, with or without at least one additional therapeutic agent, after which the cells, tissues and/or organs are subsequently implanted back into the patient.

In certain embodiments, a hybrid nuclease-albumin molecule and/or any additional therapeutic agents can be delivered by implanting certain cells that have been genetically engineered, using methods such as those described herein, to express and secrete the polypeptides. In certain embodiments, such cells can be animal or human cells, and can be autologous, heterologous, or xenogeneic. In certain embodiments, the cells can be immortalized. In certain embodiments, in order to decrease the chance of an immunological response, the cells can be encapsulated to avoid infiltration of surrounding tissues. In certain embodiments, the encapsulation materials are typically biocompatible, semi-permeable polymeric enclosures or membranes that allow the release of the protein product(s) but prevent the destruction of the cells by the patient's immune system or by other detrimental factors from the surrounding tissues.

In Vitro Assays

Various in vitro assays known in the art can be used to assess the efficacy of the hybrid nuclease-albumin molecules of the invention.

For example, RNase activity assays can be performed using commercially available kits for measuring RNase activity, e.g., the RNaseAlert™ QC System. Similarly, DNase activity assays were performed using commercially available kits for measuring DNase activity, e.g., the DNaseAlert™ QC System (Life Technologies).

In addition, cultured human PBMCs from normal or lupus patients can be isolated, cultured, and treated with various stimuli (e.g., TLR ligands, costimulatory antibodies, immune complexes, and normal or autoimmune sera), in the presence or absence of the hybrid nuclease-albumin molecules. Cytokine production by the stimulated cells can be measured using commercially available reagents, such as the antibody pair kits from Biolegend (San Diego, Calif.) for various cytokines (e.g., IL-6, IL-8, IL-10, IL-4, IFN-gamma, and TNF-alpha). Culture supernatants are harvested at various time points as appropriate for the assay (e.g., 6, 12, 24, 48 hours, or later time points) to determine the effects that the hybrid nuclease-albumin molecules have on cytokine production. Specific ELISA assays can be employed to measure cytokine output. For example, commercially available ELISA kits are available from Thermo Fisher Scientific, Inc. Similar assays are performed using human lymphocyte subpopulations (isolated monocytes, B cells, pDCs, T cells, etc.); purified using, e.g., commercially available magnetic bead based isolation kits available from Miltenyi Biotech (Auburn, Calif.).

Multi-color flow cytometry can be used to assess the effects of the hybrid nuclease-albumin molecules on immune cell activation following exposure to TLR ligands and/or immune complexes by measuring the expression of lymphocyte activation receptors such as CD5, CD23, CD69, CD80, CD86, and CD25 in PBMCs or isolated cell subpopulations at various time points after stimulation using routine art-recognized methods.

The efficacy of hybrid nuclease-albumin molecules can also be tested by incubating SLE patient serum with normal human pDCs to activate IFN output, as described in, e.g., Ahlin et al., *Lupus* 2012:21:586-95; Mathsson et al., *Clin Expt Immunol* 2007; 147:513-20; and Chiang et al., *J Immunol* 2011; 186:1279-1288. Without being bound by theory, circulating nucleic acid-containing immune complexes in SLE patient sera facilitate nucleic acid antigen entry into pDC endosomes via Fc receptor-mediated endocytosis, followed by binding of nucleic acids to and activation of endosomal TLRs 7, 8, and 9. To assess the impact of the hybrid nuclease-albumin molecules, SLE patient sera or plasma are pretreated with the hybrid nuclease-albumin molecules, followed by addition to cultures of pDC cells isolated from healthy volunteers. Levels of IFN-α produced are then determined at multiple time points. By degrading nucleic-acid containing immune complexes, effective hybrid nuclease-albumin molecules are expected to reduce the quantity of IFN-α produced.

The efficacy of hybrid nuclease-albumin molecules can be tested by profiling their ability to degrade Toll-like receptor (TLR) ligands. HEK Blue cells (Invivogen) can be engineered to express human TLRs, including TLR3 and TLR9. When cultured in the presence of an appropriate ligand, HEK Blue cells secrete an alkaline phosphatase (SEAP) that is readily detected in the conditioned medium using a colorometric substrate. For example, TLR3 recognizes dsRNA ligands, such as poly(I:C), whereas TLR9 recognizes specific unmethylated CpG-ODN sequences. Incubation of the appropriate ligand with various RSLV constructs will cause a concentration-dependent inhibition in the output of SEAP. After treatment, the amount of SEAP produced is reduced to the levels generated by non-TLR-stimulated cells. This will be consistent with the nuclease activity (RNase or DNase).

The effectiveness of hybrid nuclease-albumin molecules is demonstrated by comparing the results of an assay from cells treated with a hybrid nuclease-albumin molecules disclosed herein to the results of the assay from cells treated with control formulations. After treatment, the levels of the various markers (e.g., cytokines, cell-surface receptors, proliferation) described above are generally improved in an effective hybrid nuclease-albumin molecule treated group relative to the marker levels existing prior to the treatment, or relative to the levels measured in a control group.

Methods of Treatment

The hybrid nuclease-albumin molecules of the invention are particularly effective in the treatment of autoimmune disorders or abnormal immune responses. In this regard, it will be appreciated that the hybrid nuclease-albumin molecules of the present invention may be used to control, suppress, modulate, treat, or eliminate unwanted immune responses to both external and autoantigens.

In another aspect, a hybrid nuclease-albumin molecule is adapted for preventing (prophylactic) or treating (therapeutic) a disease or disorder, such as an autoimmune disease, in a mammal by administering an hybrid nuclease-albumin molecule in a therapeutically effective amount or a sufficient amount to the mammal in need thereof, wherein the disease is prevented or treated. Any route of administration suitable for achieving the desired effect is contemplated by the invention (e.g., intravenous, intramuscular, subcutaneous). Treatment of the disease condition may result in a decrease in the symptoms associated with the condition, which may be long-term or short-term, or even a transient beneficial effect.

Numerous disease conditions are suitable for treatment with the hybrid nuclease-albumin molecules of the invention. For example, in some aspects, the disease or disorder is an autoimmune disease or cancer. In some such aspects, the autoimmune disease is insulin-dependent diabetes mellitus, multiple sclerosis, experimental autoimmune encephalomyelitis, rheumatoid arthritis, experimental autoimmune arthritis, myasthenia gravis, thyroiditis, an experimental form of uveoretinitis, Hashimoto's thyroiditis, primary myxoedema, thyrotoxicosis, pernicious anaemia, autoimmune atrophic gastritis, Addison's disease, premature menopause, male infertility, juvenile diabetes, Goodpasture's syndrome, pemphigus vulgaris, pemphigoid, sympathetic ophthalmia, phacogenic uveitis, autoimmune haemolytic anaemia, idiopathic leucopenia, primary biliary cirrhosis, active chronic hepatitis Hbs-ve, cryptogenic cirrhosis, ulcerative colitis, Sjogren's syndrome, scleroderma, Wegener's granulomatosis, polymyositis, dermatomyositis, discoid LE, SLE, or connective tissue disease.

In a specific embodiment, a hybrid nuclease-albumin molecule is used to prevent or treat SLE or Sjogren's syndrome. The effectiveness of a hybrid nuclease-albumin molecule is demonstrated by comparing the IFN-alpha levels, IFN-alpha response gene levels, autoantibody titers, kidney function and pathology, and/or circulating immune complex levels in mammals treated with a hybrid nuclease-albumin molecule disclosed herein to mammals treated with control formulations.

For example, a human subject in need of treatment is selected or identified (e.g., a patient who fulfills the American College of Rheumatology criteria for SLE, or a patient who fulfills the American-European Consensus Sjogren's Classification Criteria). The subject can be in need of, e.g., reducing a cause or symptom of SLE or Sjogren's syndrome. The identification of the subject can occur in a clinical setting, or elsewhere, e.g., in the subject's home through the subject's own use of a self-testing kit.

At time zero, a suitable first dose of a hybrid nuclease-albumin molecule is administered to the subject. The hybrid nuclease-albumin molecule is formulated as described herein. After a period of time following the first dose, e.g., 7 days, 14 days, and 21 days, the subject's condition is evaluated, e.g., by measuring IFN-alpha levels, IFN-alpha response gene levels, autoantibody titers, kidney function and pathology, and/or circulating immune complex levels. Other relevant criteria can also be measured. The number and strength of doses are adjusted according to the subject's needs. After treatment, the subject's IFN-alpha levels, IFN-alpha response gene levels, autoantibody titers, kidney function and pathology, and/or circulating immune complex levels are lowered and/or improved relative to the levels existing prior to the treatment, or relative to the levels measured in a similarly afflicted but untreated/control subject.

In another example, a rodent subject in need of treatment is selected or identified (see, e.g., Example 9). The identification of the subject can occur in a laboratory setting or elsewhere. At time zero, a suitable first dose of a hybrid nuclease-albumin molecule is administered to the subject. The hybrid nuclease-albumin molecule is formulated as described herein. After a period of time following the first dose, e.g., 7 days, 14 days, and 21 days, the subject's condition is evaluated, e.g., by measuring IFN-alpha levels, IFN-alpha response gene levels, autoantibody titers, kidney function and pathology, and/or circulating immune complex levels. Other relevant criteria can also be measured. The number and strength of doses are adjusted according to the subject's needs.

After treatment, the subject's IFN-alpha levels, IFN-alpha response gene levels, autoantibody titers, kidney function and pathology, and/or circulating immune complex levels are lowered and/or improved relative to the levels existing prior to the treatment, or relative to the levels measured in a similarly afflicted but untreated/control subject.

Another aspect of the present invention is to use gene therapy methods for treating or preventing disorders, diseases, and conditions with one or more hybrid nuclease-albumin molecules. The gene therapy methods relate to the introduction of hybrid nuclease-albumin molecule nucleic acid (DNA, RNA and antisense DNA or RNA) sequences into an animal in need thereof to achieve expression of the polypeptide or polypeptides of the present invention. This method can include introduction of one or more polynucleotides encoding a hybrid nuclease-albumin molecule polypeptide of the present invention operably coupled to a promoter and any other genetic elements necessary for the expression of the polypeptide by the target tissue.

In gene therapy applications, hybrid nuclease-albumin molecule genes are introduced into cells in order to achieve in vivo synthesis of a therapeutically effective genetic product. "Gene therapy" includes both conventional gene therapies where a lasting effect is achieved by a single treatment, and the administration of gene therapeutic agents, which involves the one time or repeated administration of a therapeutically effective DNA or mRNA. The oligonucleotides can be modified to enhance their uptake, e.g., by substituting their negatively charged phosphodiester groups by uncharged groups.

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, Proteins: Structures and Molecular Properties (W.H. Freeman and Company, 1993); A. L. Lehninger, Biochemistry (Worth Publishers, Inc., current addition); Sambrook, et al, Molecular Cloning: A Laboratory Manual (2nd Edition, 1989); Methods In Enzymology (S. Colowick and N. Kaplan eds., Academic Press, Inc.); Remington's Pharmaceutical Sciences, 18th Edition (Easton, Pa.: Mack Publishing Company, 1990); Carey and Sundberg Advanced Organic Chemistry $3^{rd}$ Ed. (Plenum Press) Vols A and B (1992).

Example 1

Generating Hybrid Nuclease-Albumin Molecule Encoding Expression Vectors

RSLV-132 and RSLV-133 are nuclease fusion constructs engineered on the Fc scaffold of human IgG1, described in WO 2012/149440, herein incorporated by reference. The Fc portion extends the circulatory half-life of the constructs in vivo. Human serum albumin (HSA), like IgG1, possesses a prolonged circulatory half-life as a result of being recycled via the neonatal Fc receptor (FcRn). Unlike an Fc construct which naturally forms a dimer, HSA is monomeric. To explore whether the HSA scaffold offered advantages for constructing long-lived nuclease fusion constructs, a series of novel dual nuclease-containing HSA fusion constructs (both RNase and DNase) were designed, expressed, and characterized.

Various embodiments of the hybrid nuclease-albumin molecules of the invention are shown in FIG. 1, with amino acid sequences of each presented in Table 1. Several of the following exemplary hybrid nuclease-albumin molecules, RSLV-301, RSLV-302, RSLV-303, RSLV-304, RSLV-305, RSLV-306, RSLV-307, RSLV-308, RSLV-309, RSLV-310, RSLV-311, RSLV-312, RSLV-313, RSLV-314, RSLV-315, RSLV-316, RSLV-317, RSLV-318, RSLV-319, RSLV-320, RSLV-321, RSLV-322, RSLV-323, RSLV-324, RSLV-325, RSLV-326, RSLV-327, RSLV-328, RSLV-329, RSLV-330, RSLV-331, and RSLV-332 were constructed. Specifically, starting from the amino acid sequence of the hybrid nuclease-albumin molecules, polynucleotides encoding the hybrid nuclease-albumin molecules were directly synthesized using codon optimization by Genescript (Genescript, Piscatawy, N.J.) to allow for optimal expression in mammalian cells. The process of optimization involved, e.g., avoiding regions of very high (>80%) or very low (<30%) GC content when possible, and avoiding cis-acting sequence motifs, such as internal TATA-boxes, chi-sites and ribosomal entry sites, AT-rich or GC-rich sequence stretches, RNA instability motifs, repeat sequences and RNA secondary structures, and cryptic splice donor and acceptor sites in higher eukaryotes. Plasmids encoding the hybrid nuclease-albumin molecules were obtained from GeneArt in the pcDNA3.1+ mammalian expression vector. The following hybrid nuclease-albumin molecules referred to as RSLV-301, RSLV-302, RSLV-303, RSLV-304, RSLV-308, RSLV-310, RSLV-311, RSLV-312, RSLV-313, RSLV-314, RSLV- 319, RSLV-320, RSLV-323, RSLV-324, RSLV-327, RSLV-328, and RSLV-329 were generated by transforming the plasmids into DH10B competent cells. The cultures were expanded under ampicillin selection and DNA was prepared for transfection using the Qiagen Plasmid Plus Maxi Kit.

RSLV-301 (SEQ ID NO: 18) has the configuration HSA-RNase1, wherein a wild-type, human RNase1 domain (SEQ ID NO: 75) is operably coupled to the C-terminus of wild-type HSA (SEQ ID NO: 1). The nucleic acid sequence of RSLV-301 is set forth in SEQ ID NO: 90.

RSLV-302 (SEQ ID NO: 19) has the configuration RNase1-HSA, wherein a wild-type, human RNase1 domain is operably coupled to the N-terminus of wild-type HSA. The nucleic acid sequence of RSLV-302 is set forth in SEQ ID NO: 91.

RSLV-303 (SEQ ID NO: 20) has the configuration HSA-(Gly$_4$Ser)$_3$ (SEQ ID NO: 85)-RNase1, wherein a wild-type, human RNase1 domain is operably coupled via a (Gly$_4$Ser)$_3$ linker (SEQ ID NO: 85) to the C-terminus of wild-type HSA. The nucleic acid sequence of RSLV-303 is set forth in SEQ ID NO: 92.

RSLV-304 (SEQ ID NO: 21) has the configuration RNase1-(Gly$_4$Ser)$_3$ (SEQ ID NO: 85)-HSA, wherein a wild-type, human RNase1 domain is operably coupled via a (Gly$_4$Ser)$_3$ (SEQ ID NO: 85) linker to the N-terminus of wild-type HSA. The nucleic acid sequence of RSLV-304 is set forth in SEQ ID NO: 93.

RSLV-305 (SEQ ID NO: 22) has the configuration RNase1-HSA-RNase1, wherein a first wild-type, human RNase1 domain is operably coupled to the N-terminus of wild-type HSA, and a second wild-type, human RNase1 domain is operably coupled to the C-terminus of wild-type HSA.

RSLV-306 (SEQ ID NO: 23) has the configuration RNase1-(Gly$_4$Ser)$_3$ (SEQ ID NO: 85)-HSA-(Gly$_4$Ser)$_3$ (SEQ ID NO: 85)-RNase1, wherein a first wild-type, human RNase1 domain is operably coupled via a first (Gly$_4$Ser)$_3$ (SEQ ID NO: 85) sequence to the N-terminus of wild-type HSA, and a second wild-type, human RNase1 domain is operably coupled via a second (Gly$_4$Ser)$_3$ (SEQ ID NO: 85) sequence to the C-terminus of wild-type HSA.

RSLV-307 (SEQ ID NO: 24) has the configuration RNase1-HSA-DNase1 A114F, wherein a wild-type, human RNase1 domain is operably coupled to the N-terminus of wild-type HSA, and a mutant, human DNase1 A114F domain (SEQ ID NO: 68) is operably coupled to the C-terminus of wild-type HSA.

RSLV-308 (SEQ ID NO: 25) has the configuration RNase1-(Gly$_4$Ser)$_3$ (SEQ ID NO: 85)-HSA-(Gly$_4$Ser)$_3$ (SEQ ID NO: 85)-DNase1 A114F, wherein a wild-type, human RNase1 domain is operably coupled via a first (Gly$_4$Ser)$_3$ (SEQ ID NO: 85) sequence to the N-terminus of wild-type HSA, and a mutant, human DNase1 A114F domain is operably coupled via a second (Gly$_4$Ser)$_3$ (SEQ ID NO: 85) sequence to the C-terminus of wild-type HSA. The nucleic acid sequence of RSLV-308 is set forth in SEQ ID NO: 94.

RSLV-309 (SEQ ID NO: 26) has the configuration DNase1 A114F-HSA-RNase1, wherein a mutant, human DNase1 A114F domain is operably coupled to the N-terminus of wild-type HSA, and a wild-type, human RNase1 domain is operably coupled to the C-terminus of wild-type HSA.

RSLV-310 (SEQ ID NO: 27) has the configuration DNase1 A114F-(Gly$_4$Ser)$_3$ (SEQ ID NO: 85)-HSA-(Gly$_4$Ser)$_3$ (SEQ ID NO: 85)-RNase1, wherein a mutant, human DNase1 A114F domain is operably coupled via a first (Gly$_4$Ser)$_3$ (SEQ ID NO: 85) sequence to the N-terminus of wild-type HSA, and a wild-type, human RNase1 domain is operably coupled via a second (Gly$_4$Ser)$_3$ (SEQ ID NO: 85) sequence to the C-terminus of wild-type HSA. The nucleic acid sequence of RSLV-310 is set forth in SEQ ID NO: 95.

RSLV-311 (SEQ ID NO: 28) has the configuration DNase1 A114F-HSA, wherein a mutant, human DNase1 A114F domain is operably coupled to the N-terminus of wild-type HSA. The nucleic acid sequence of RSLV-311 is set forth in SEQ ID NO: 96.

RSLV-312 (SEQ ID NO: 29) has the configuration HSA-DNase1 A114F, wherein a mutant, human DNase1 A114F domain is operably coupled to the C-terminus of wild-type HSA. The nucleic acid sequence of RSLV-312 is set forth in SEQ ID NO: 97.

RSLV-313 (SEQ ID NO: 30) has the configuration DNase1 A114F-(Gly$_4$Ser)$_3$ (SEQ ID NO: 85)-HSA, wherein a mutant, human DNase1 A114F domain is operably coupled via a (Gly$_4$Ser)$_3$ sequence to the N-terminus of wild-type HSA. The nucleic acid sequence of RSLV-313 is set forth in SEQ ID NO: 98.

RSLV-314 (SEQ ID NO: 31) has the configuration HSA-(Gly$_4$Ser)$_3$ (SEQ ID NO: 85) DNase1 A114F, wherein a mutant, human DNase1 A114F domain is operably coupled via a (Gly$_4$Ser)$_3$ (SEQ ID NO: 85) sequence to the C-terminus of wild-type HSA. The nucleic acid sequence of RSLV-314 is set forth in SEQ ID NO: 99.

RSLV-315 (SEQ ID NO: 32) has the configuration RNase1 N34S/N76S/N88S-(Gly$_4$Ser)$_3$ (SEQ ID NO: 85)-HSA, wherein a mutant, human RNase1 N34S/N76S/N88S domain (SEQ ID NO: 84) is operably coupled via a (Gly$_4$Ser)$_3$ (SEQ ID NO: 85) linker to the N-terminus of wild-type HSA. The asparagines residues at positions 62, 104, and 116 (potential acceptors of N-linked glycosylation) of human RNase1 are mutated to serine.

RSLV-316 (SEQ ID NO: 33) has the configuration HSA-(Gly$_4$Ser)$_3$ (SEQ ID NO: 85)-RNase1 N34S/N76S/N88S, wherein a mutant, human RNase1 domain N34S/N76S/N88S is operably coupled via a (Gly$_4$Ser)$_3$ (SEQ ID NO: 85) linker to the C-terminus of wild-type HSA.

RSLV-317 (SEQ ID NO: 34) has the configuration DNase1 N/40S/N128S/A114F-(Gly$_4$Ser)$_3$ (SEQ ID NO: 85)-HSA, wherein a mutant, human DNase1 N18S/N106S/A114F domain (SEQ ID NO: 83) is operably coupled via a (Gly$_4$Ser)$_3$ (SEQ ID NO: 85) linker to the N-terminus of wild-type HSA. The asparagine residues at positions 40 and 128 of human DNase1 are potential acceptors of N-linked glycosylation.

RSLV-318 (SEQ ID NO: 35) has the configuration HSA-(Gly$_4$Ser)$_3$ (SEQ ID NO: 85)-DNase1 N18S/N106S/A114F, wherein a mutant, human DNase1 domain N18S/N106S/A114F is operably coupled via a (Gly$_4$Ser)$_3$ (SEQ ID NO: 85) linker to the C-terminus of wild-type HSA.

RSLV-319 (SEQ ID NO: 36) has the configuration RNase1 N34S/N76S/N88S-(Gly$_4$Ser)$_3$ (SEQ ID NO: 85)-HSA-(Gly$_4$Ser)$_3$ (SEQ ID NO: 85)-DNase1 A114F, wherein a mutant, human RNase1 N34S/N76S/N88S domain is operably coupled via a first (Gly$_4$Ser)$_3$ (SEQ ID NO: 85) sequence to the N-terminus of wild-type HSA, and a mutant, human DNase1 A114F domain is operably coupled via a second (Gly$_4$Ser)$_3$ (SEQ ID NO: 85) sequence to the C-terminus of wild-type HSA.

RSLV-320 (SEQ ID NO: 37) has the configuration DNase1 A114F-(Gly$_4$Ser)$_3$ (SEQ ID NO: 85)-HSA-(Gly$_4$Ser)$_3$ (SEQ ID NO: 85)-RNase1 N34S/N76S/N88S, wherein a mutant, human DNase1 A114F domain is operably coupled via a first (Gly$_4$Ser)$_3$ (SEQ ID NO: 85)

sequence to the N-terminus of wild-type HSA, and a mutant, human RNase1 N34S/N76S/N88S domain is operably coupled via a second (Gly$_4$Ser)$_3$ (SEQ ID NO: 85) sequence to the C-terminus of wild-type HSA.

RSLV-321 (SEQ ID NO: 38) has the configuration RNase1 N34S/N76S/N88S-(Gly$_4$Ser)$_3$ (SEQ ID NO: 85)-HSA-(Gly$_4$Ser)$_3$ (SEQ ID NO: 85)-DNase1 N18S/N106S/A114F, wherein a mutant, human RNase1 N34S/N76S/N88S domain is operably coupled via a first (Gly$_4$Ser)$_3$ (SEQ ID NO: 85) sequence to the N-terminus of wild-type HSA, and a mutant, human DNase1 N18S/N106S/A114F domain is operably coupled via a second (Gly$_4$Ser)$_3$ (SEQ ID NO: 85) sequence to the C-terminus of wild-type HSA.

RSLV-322 (SEQ ID NO: 39) has the configuration DNase1 N18S/N106S/A114F-(Gly$_4$Ser)$_3$-HSA-(Gly$_4$Ser)$_3$ (SEQ ID NO: 85)-RNase1 N34S/N76S/N88S, wherein a mutant, human DNase1 N18S/N106S/A114F domain is operably coupled via a first (Gly$_4$Ser)$_3$ (SEQ ID NO: 85) sequence to the N-terminus of wild-type HSA, and a mutant, human RNase1 N34S/N76S/N88S domain is operably coupled via a second (Gly$_4$Ser)$_3$ (SEQ ID NO: 85) sequence to the C-terminus of wild-type HSA.

RSLV-323 (SEQ ID NO: 40) has the configuration DNase1 A114F-(Gly$_4$Ser)$_3$ (SEQ ID NO: 85)-RNase1-HSA, wherein a mutant, human DNase1 A114F domain is operably coupled via a (Gly$_4$Ser)$_3$ (SEQ ID NO: 85) sequence to a wild-type, human RNase1, and wherein the wild-type human RNase1 is operably coupled to the N-terminus of wild-type HSA.

RSLV-324 (SEQ ID NO: 41) has the configuration HSA-RNase1-(Gly$_4$Ser)$_3$ (SEQ ID NO: 85)-DNase1 A114F, wherein a mutant, human DNase1 A114F domain is operably coupled via a (Gly$_4$Ser)$_3$ (SEQ ID NO: 85) sequence to a wild-type, human RNase1, and wherein the wild-type human RNase1 is operably coupled to the C-terminus of wild-type HSA.

RSLV-325 (SEQ ID NO:110) has the configuration HSA-(Gly4Ser)3 (SEQ ID NO: 85)-DNase1 E13R/N74K/A114F/T205K, wherein the wild-type human HSA is operably coupled via a (Gly4Ser)3 (SEQ ID NO: 85) sequence to a DNase1 E13R/N74K/A114F/T205K domain.

RSLV-326 (SEQ ID NO:111) has the configuration DNase1 E13R/N74K/A114F/T205K-(Gly4Ser)3 (SEQ ID NO: 85)-HSA, wherein a DNase1 E13R/N74K/A114F/T205K domain is operably coupled via a (Gly4Ser)3 (SEQ ID NO: 85) sequence to a wild-type HSA.

RSLV-327 (SEQ ID NO:112) has the configuration RNase1-(Gly4Ser)3 (SEQ ID NO: 85)-HSA-(Gly4Ser)3 (SEQ ID NO: 85)-DNase1 E13R/N74K/A114F/T205K, wherein RNase1 is operably coupled via a (Gly4Ser)3 (SEQ ID NO: 85) sequence to a wild-type HSA, and wherein the wild-type HSA is operably coupled via a (Gly4Ser)3 (SEQ ID NO: 85) sequence to a DNase1 E13R/N74K/A114F/T205K domain.

RSLV-328 (SEQ ID NO: 113) has the configuration DNase1 E13R/N74K/A114F/T205K domain-(Gly4Ser)3 (SEQ ID NO: 85)-HSA-(Gly4Ser)3 (SEQ ID NO: 85)-RNase1, wherein DNase1 E13R/N74K/A114F/T205K is operably coupled via a (Gly4Ser)3 (SEQ ID NO: 85) sequence to a wild-type HSA, and wherein the wild-type HSA is operably coupled via a (Gly4Ser)3 (SEQ ID NO: 85) sequence to a RNase1 domain.

RSLV-329 (SEQ ID NO:114) has the configuration RNase1-(Gly4Ser)3 (SEQ ID NO: 85)-HSA-NLG-DNase1 E13R/N74K/A114F/T205K, wherein RNase1 is operably coupled via a (Gly4Ser)3 (SEQ ID NO: 85) sequence to a wild-type HSA, and wherein the wild-type human HSA is operably coupled via a NLG sequence to a DNase1 E13R/N74K/A114F/T205K domain.

RSLV-330 (SEQ ID NO:115) has the configuration DNase1 E13R/N74K/A114F/T205K/N18S/N106S-(Gly4Ser)3 (SEQ ID NO: 85)-HSA, wherein a DNase1 E13R/N74K/A114F/T205K/N18S/N106S domain is operably coupled via a (Gly4Ser)3 (SEQ ID NO: 85) sequence to a wild-type HAS.

RSLV-331 (SEQ ID NO:116) has the configuration RNase1-(Gly4Ser)3 (SEQ ID NO: 85)-HSA-(Gly4Ser)3 (SEQ ID NO: 85)-DNase1 E13R/N74K/A114F/T205K/N18S/N106S, wherein RNase1 is operably coupled via a (Gly4Ser)3 (SEQ ID NO: 85) sequence to a wild-type HSA, and wherein the wild-type HSA is operably coupled via a (Gly4Ser)3 (SEQ ID NO: 85) sequence to a DNase1 E13R/N74K/A114F/T205K/N18S/N106S domain.

RSLV-332 (SEQ ID NO:117) has the configuration DNase1 E13R/N74K/A114F/T205K/N18S/N106S domain-(Gly4Ser)3 (SEQ ID NO: 85)-HSA-(Gly4Ser)3 (SEQ ID NO: 85)-RNase1, wherein DNase1 E13R/N74K/A114F/T205K/N18S/N106S is operably coupled via a (Gly4Ser)3 (SEQ ID NO: 85) sequence to a wild-type HSA, and wherein the wild-type HSA is operably coupled via a (Gly4Ser)3 (SEQ ID NO: 85) sequence to a RNase1 domain.

The hybrid nuclease-albumin molecules of the invention can also be generated using conventional cloning techniques well-known in the art, for example, by preparing modular cassettes of each component of the hybrid nuclease-albumin molecule (e.g., nuclease domain, linker domain, HSA) with compatible restriction enzyme sites to allow for shuttling and domain swapping. A polynucleotide encoding each component of the hybrid nuclease-albumin molecule (e.g., RNase, DNase, HSA) can be readily obtained by amplifying the component of interest using polymerase chain reaction (PCR) from an appropriate cDNA library. For example, the full length nucleotide sequences of human RNase1, DNase1, and HSA can be amplified from random primed and oligo dT primed cDNA derived from commercially available human pancreatic total RNA (Ambion/Applied Biosystems, Austin, Tex.) using sequence specific 5' and 3' primers based on published sequences of the component being amplified (or as shown in Table 1). PCR amplicons are purified by agarose gel electrophoresis and subsequent application to QIAquick gel purification columns. Purified amplicons are cloned into a convenient vector for subcloning and subsequent domain swapping and shuttling (e.g., pC42.1 TOPO cloning vector; Invitrogen, Carlsbad, Calif.). Polynucleotides encoding mutant nuclease domains or HSA variants are generated by introducing mutations into the domain of interest using commercially available kits (e.g., QuickChange™ site-directed mutagenesis kit; Stratagene), or overlap extension PCR to introduce mutations at desired positions, followed by DNA sequencing to confirm that the intended mutations are introduced. Linkers (e.g., (Gly4Ser)3 (SEQ ID NO: 85)) linkers can be generated by overlap PCR using routine methods, or through direct synthesis using commercially available services, and designed to have overhangs or be blunt to facilitate subsequent cloning to allow for fusion with other domains of interest.

Example 2

Transient Expression of Hybrid Nuclease-Albumin Molecules

For transient expression, the expression vectors from Example 1 containing the hybrid nuclease-albumin molecule inserts (i.e., RSLV-301, RSLV-302, RSLV-303, RSLV-304, RSLV-308, RSLV-310, RSLV-311, RSLV-312, RSLV-313, RSLV-314, RSLV-319, RSLV-320, RSLV-323, RSLV-324, RSLV-327, RSLV-328, and RSLV-329 were transiently transfected using FreeStyle™ MAX Reagent into Chinese Hamster Ovary (CHO) cells, e.g., CHO-S cells (e.g., FreeStyle™ CHO-S cells, Life Technologies).

Transfections were performed using the FreeStyle MAX CHO Expression System obtained from Life Technologies. One day prior to transfection, CHO-S cells were seeded at a density of $5 \times 10^6$ cells/ml in 150 ml of FreeStyle CHO expression medium supplemented with 8 mM glutamine; the flasks subsequently were placed on an orbital shaker rotating at 120-135 rpm and incubated overnight in an 8% $CO_2$ incubator at 37° C. On the day of transfection, the CHO-S cells were harvested then re-seeded at a density of $1 \times 10^6$ cells/ml in 150 ml of FreeStyle CHO Expression Medium supplemented with 8 mM L-glutamine. 187.5 µg of an individual plasmid DNA was diluted into 3 ml of OptiPRO SFM and mixed by repeated inversion. In a separate tube, 187.5 µL of FreeStyle MAX transfection reagent was mixed with 3 ml of OptiPro SFM and by inversion. The diluted FreeStyle MAX transfection reagent then was immediately added to the diluted plasmid DNA solution (total volume=6 ml); the resulting solution was mixed gently by inversion and complexes were allowed to form for 10 min at room temperature. The transfection mixture then was slowly added to the 150 ml culture of CHO-S cells while gently swirling the flask. The cultures were incubated on an orbital shaker platform (120-135 rpm) at 37° C. in an 8% $CO_2$ incubator. After 5 days of growth, cells were harvested by centrifugation (1000 rpm for 10 min) and the conditioned medium was recovered, filtered by passage through a 0.22 µm membrane, and frozen. Transfection volumes were scaled up to obtain larger volumes of supernatant.

Expression of the hybrid nuclease-albumin molecules was assayed by standard Western Blot analysis. Expression of each of the generated hybrid nuclease-albumin molecules was observed at the expected size.

Figure 2:
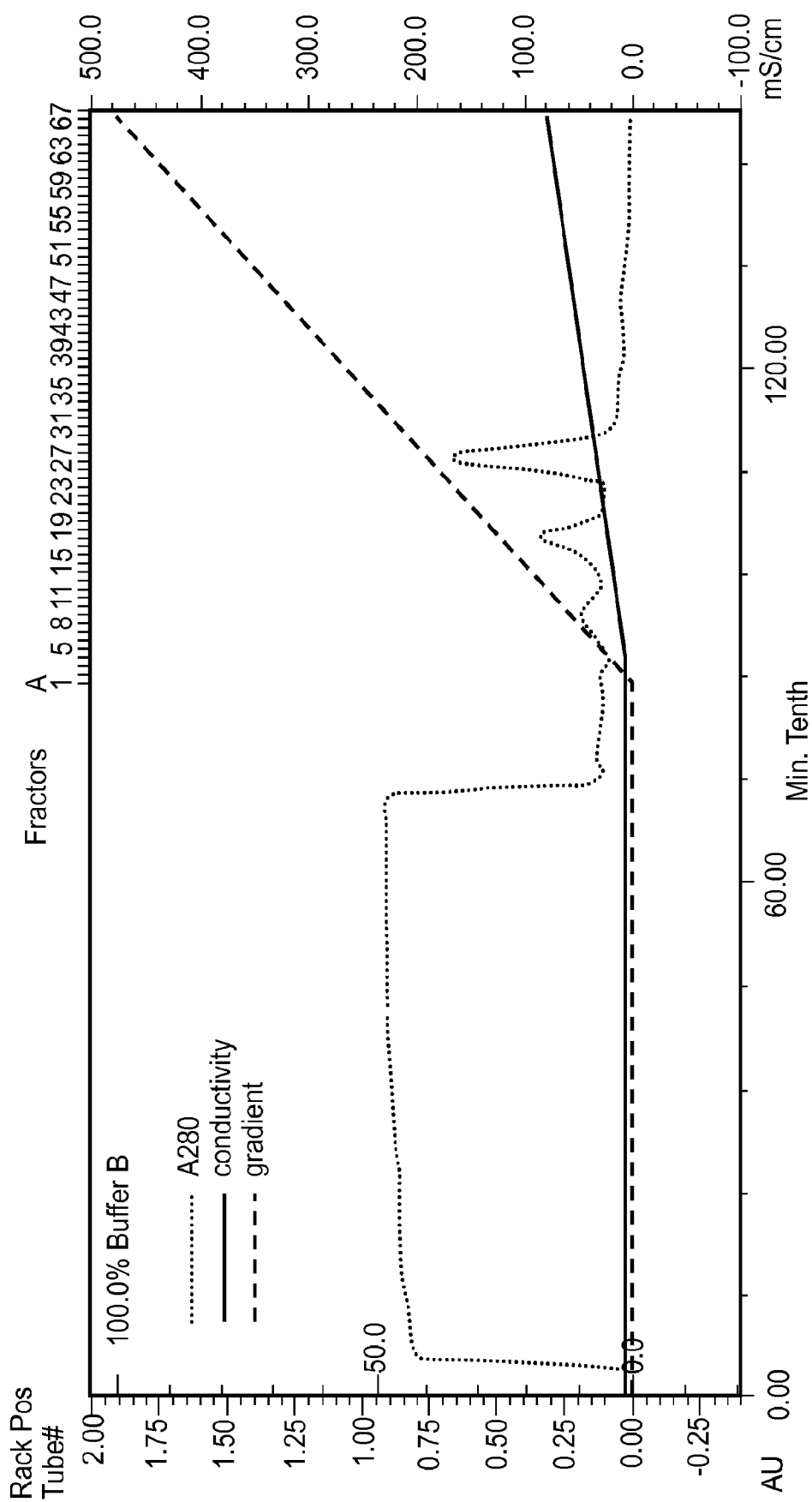
FIG. 2 is a graph depicting the Q-SEPHAROSE™ chromatography of RSLV-308. The point at which the gradient was initiated is indicated via the dashed line. The x-axis indicates elution time in minutes.
Figure 3:
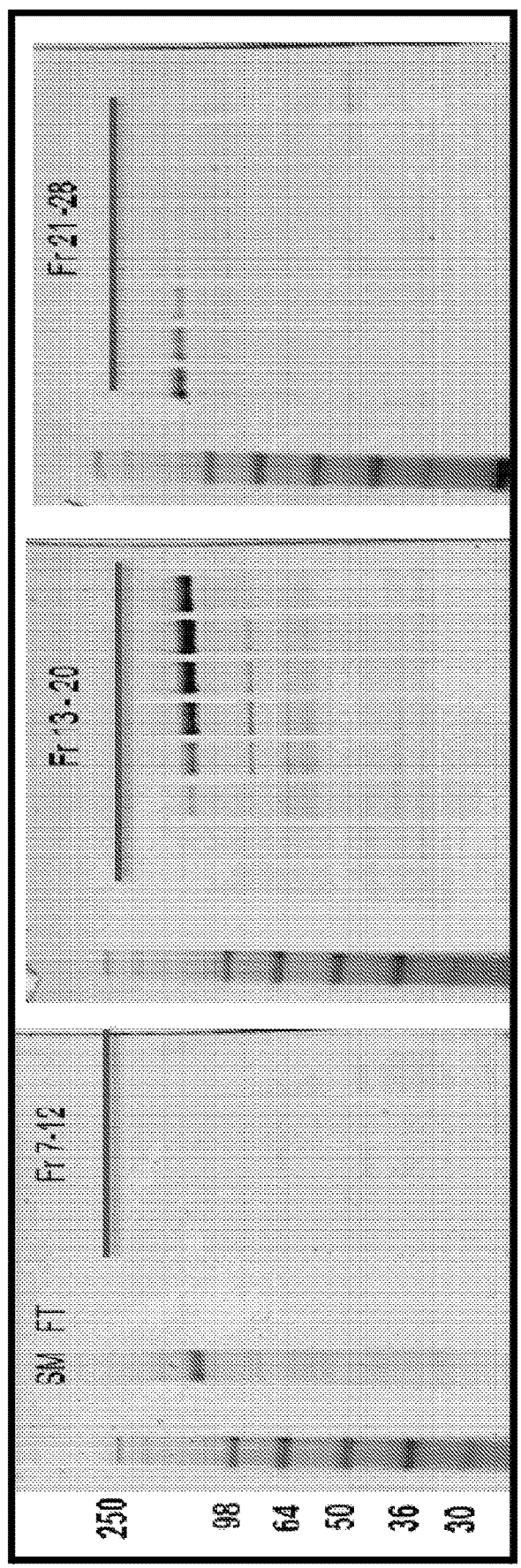
FIG. 3 depicts SDS PAGE analysis of fractions generated during Q-SEPHAROSE™ chromatography of conditioned medium harvested from RSLV-308 transfected CHO-S cells. SM=starting material. FT=flow-through. Fr=fractions 7-28.

The hybrid nuclease-albumin molecules were purified using a two-step purification process. The following is based on purification of RSLV-308. First, ion exchange chromatography using Q-SEPHAROSE™ Fast Flow resin (GE Healthcare) was performed. Specifically, culture supernatants were diluted with 2 volumes of 75 mM Hepes pH 7.2 and passed over a Q-SEPHAROSE™ Fast Flow column, previously equilibrated with Buffer A (50 mM Hepes pH 7.2, 50 mM NaCl, 1 mM $CaCl_2$), with a 20 ml bed volume at 6 ml/minute with continuous monitoring ($OD_{280}$). The column was then washed with 100 ml Buffer A. A linear gradient was run from 100% Buffer A to 100% Buffer B (50 mM Hepes pH 7.2, 1 M NaCl, 1 mM $CaCl_2$) in 400 ml, during which six ml fractions were collected (FIG. 2). To identify fractions containing RSLV-308, aliquots of the individual fractions were subjected to SDS gel electrophoresis. Fractions were diluted by adding 10 µl of 4× Protein Loading Buffer (Licor) to 30 µl of the individual fraction and heat denatured. Samples were electrophoresed using Novex 4-20% Tris-Glycine gradient gels, 1.0 mm×10 wells (Invitrogen), 30 µl of each diluted sample loaded/well, and visualized with Simply Blue Safe Stain (Invitrogen) (FIG. 3). As shown in FIG. 3, a major Simply Blue staining band was detected in the starting material (lame SM) with an apparent MW of 110 kDa. The theoretical mass of RSLV-308 based on its amino acid sequence is 112 kDa. Following application of the conditioned medium, the flow through (lane FT) was depleted of the 110 kDa species, indicating binding of this species to the resin. After initiation of the NaCl gradient, the 110 kDa species was recovered predominantly in fractions 16-22. These fractions corresponded to the OD280 peak eluting between 96 and 108 minutes (FIG. 2). The hybrid nuclease-albumin molecules were also visualized by Western Blot analysis to migrate at the expected size.

Figure 4A:
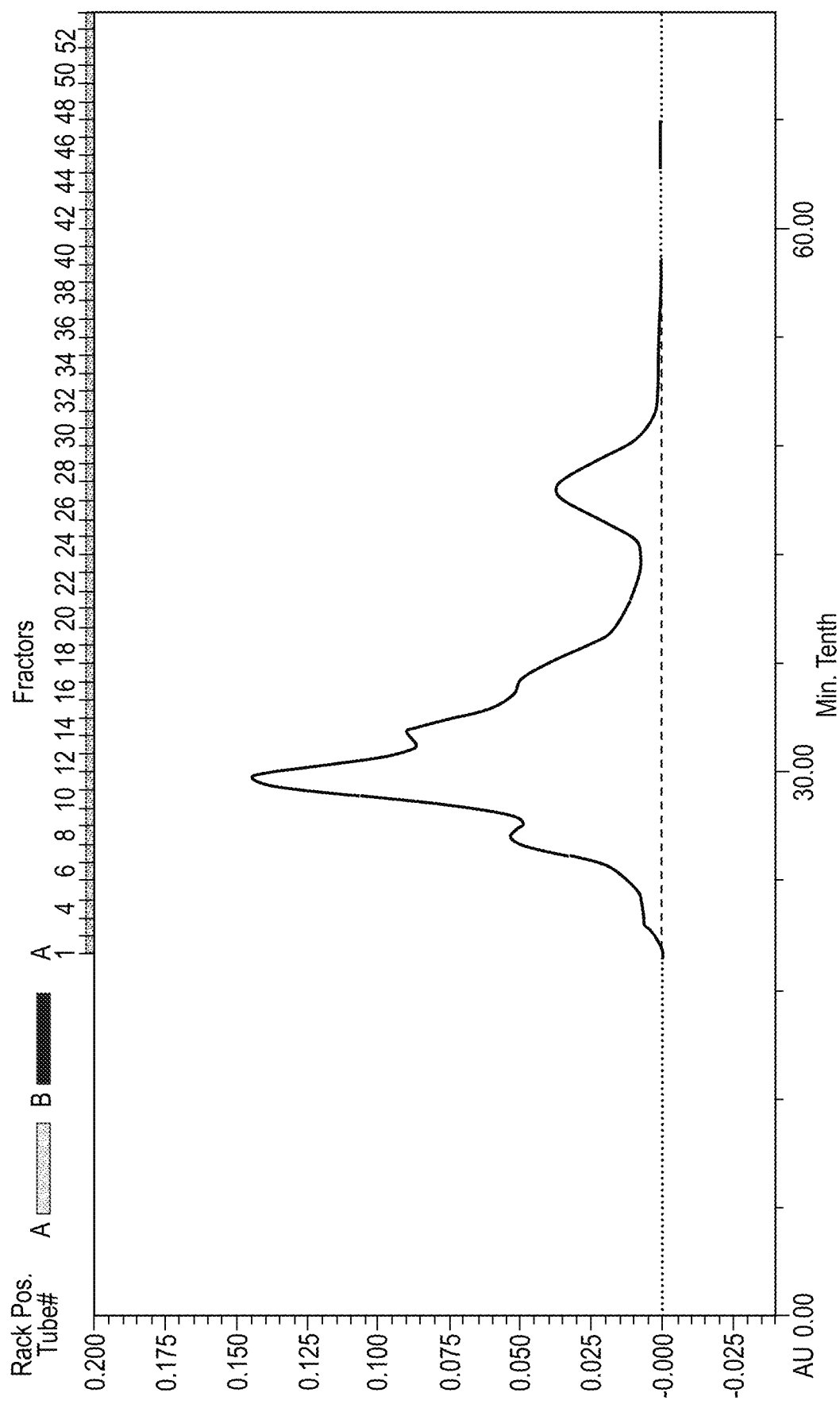
FIG. 4A is a graph depicting the elution profile of RSLV-308. The y-axis indicates $OD_{280}$ and the x-axis indicates time in tenths of a minute.
Figure 4B:
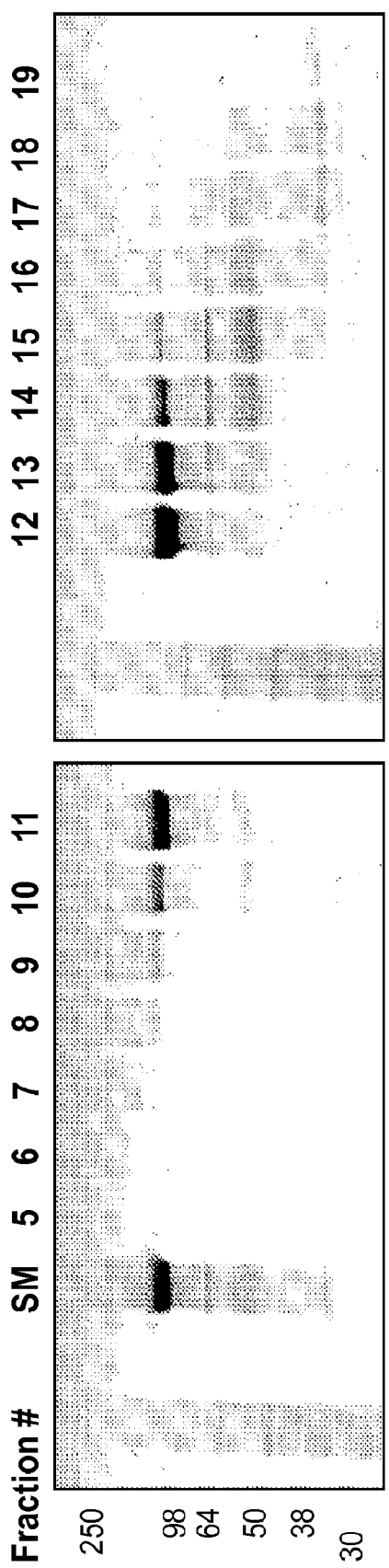
FIG. 4B depicts analysis of individual fractions by SDS PAGE. SM=starting Q-SEPHAROSE™ pooled concentrate.

As a second purification step, preparative size exclusion chromatography using SUPERDEX™ 200 10/300 (GE Healthcare) was performed. Q-SEPHAROSE™ fractions 17-21 were pooled and the included protein concentrated to 1 ml using Pierce protein concentrators with a 9K MW cut off and filtered at 0.22 µm. 500 µl of the concentrated pool was injected into a SUPERDEX™ 2 00 10/300 column that had been equilibrated with 25 mM Hepes pH 7.0, 1 mM $CaCl_2$ and 150 mM NaCl running buffer. The flow rate was 0.5 ml/minute and 0.5 ml fractions were collected throughout the run. As shown in FIG. 4A, the resulting $OD_{280}$ elution prolife indicated the presence of a large heterogenous forward peak and a smaller trailing peak Aliquots of the individual fractions were analyzed by SDS PAGE to visualize elution of the 110 kDa RSLV-308 species. Fractions were diluted by adding 10 µl of 4× Protein Loading Buffer (Licor) to 30 µl of each fraction. Samples were electrophoresed using Novex 4-20% Tris-Glycine gradient gels, 1.0 mm×10 wells (Invitrogen), 30 µl diluted sample/well and visualized with Simply Blue Safe Stain (Invitrogen) (FIG. 4B). As shown in FIG. 4B, the 110 kDa species eluted as a single peak corresponding to fractions 10-14. Numerous lower MW species were detected in fractions 13-19; the identity of these polypeptides is unknown. To maximize purity, only fractions 10-13 were pooled as final product. The remaining 0.5 mL of the concentrated Q-SEPHAROSE™ was subjected to the same SUPERDEX™ chromatography step and the resulting pooled fractions were combined with those generated during the first run as the final yield. The purified hybrid nuclease-albumin molecules were also visualized by Western Blot analysis at the expected size.

Each of the RSLV-300 series constructs that were purified followed the schema described herein for RSLV-308. The Q-SEPHAROSE™ and SUPERDEX™ 200 elution profiles were very similar for each construct Table 2 summarizes the overall yields that were achieved from the purification efforts. Final protein concentrations of the SEC purified pools were calculated based on measured $OD_{280}$ values and theoretical extinction coefficients.

TABLE 2

Recovery of RSLV-300 constructs following transient transfection in CHO-S cells

| RSLV-300 Construct | Starting Volume of Conditioned Medium from CHO-S Transfection (ml) | Total Protein Yield from 2-Step Purification* (mg) | Production Titer (ug/ml) |
|---|---|---|---|
| RSLV-308 | 150 | 0.65 | 4.3 |
| RSLV-310 | 250 | 1.65 | 6.6 |
| RSLV-319 | 150 | 0.79 | 5.3 |
| RSLV-320 | 300 | 2.18 | 7.3 |
| RSLV-323 | 150 | 2.10 | 14.0 |
| RSLV-324 | 195 | 0.56 | 2.9 |
| RSLV-327 | 300 | 0.74 | 2.5 |
| RSLV-328 | 300 | 1.55 | 5.2 |

*In some cases, only 0.5 ml of each of the concentrated Q-SEPHAROSE ™ pools (of the individual RSLV-300 constructs) was applied to the SUPERSEX ™ 200 column. Overall yields are based on recovery of protein from this 0.5 ml aliquot and corrected for the total volume of Q-SEPHAROSE ™ pool.

Example 3

Biochemical Characterization

Western Blot Analysis

Figure 5:
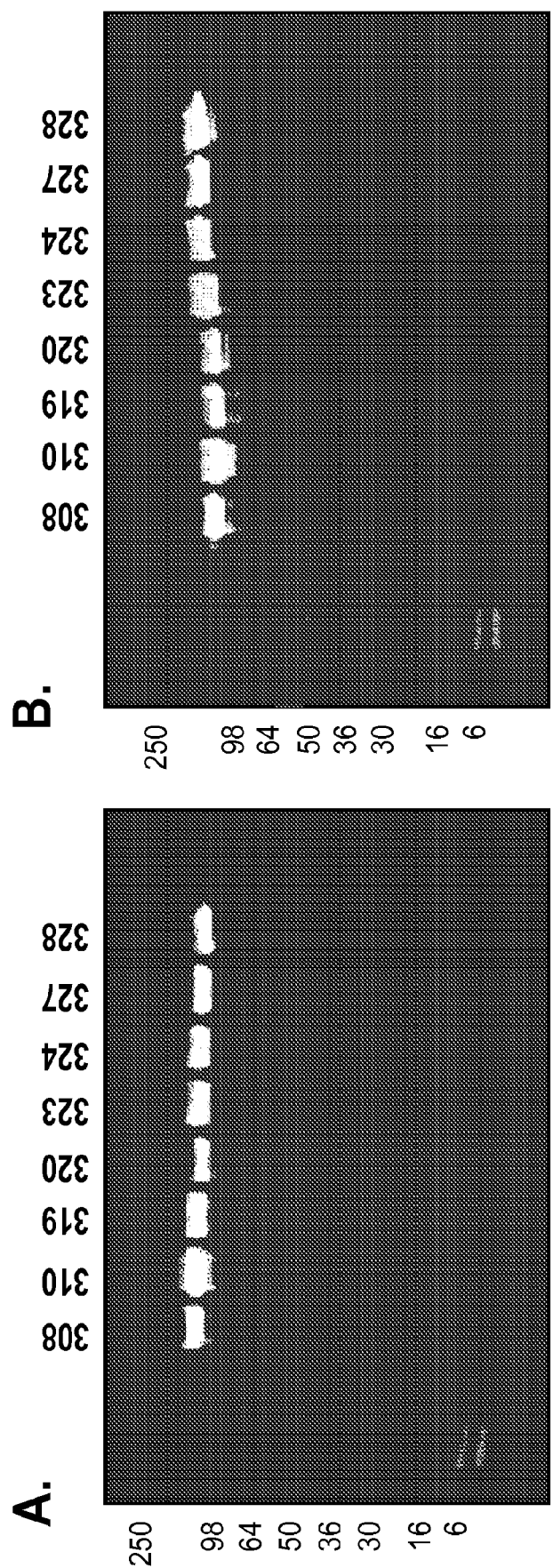
FIGS. 5A-B depict Western Blot analysis of RSLV-300 constructs. A) is probed for RNase1 and HSA and B) is probed for DNaseA1 and HSA. In both A and B, all eight constructs appeared yellow, indicating binding of both antibodies to the constructs.
Figure 6:
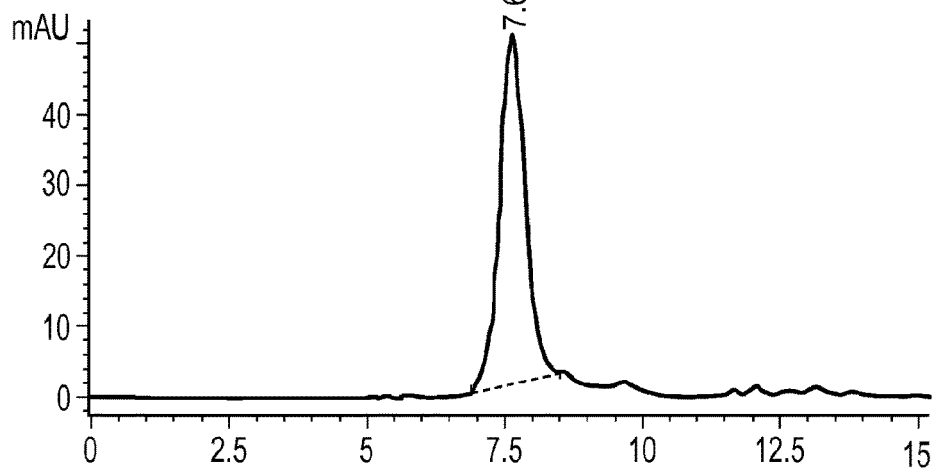
FIGS. 6A-C are graphs depicting analysis of three HSA constructs by HPLC SEC. The chromatograms show the $OD_{280}$ tracing as a function of the elution time (minutes). A) 90 μg of RSLV-308; peak at 7.64 min. B) 118 μg of RSLV-327; peak at 7.64 min. C) 328 μg of RSLV-328; peak at 7.73 min.
Figure 6:
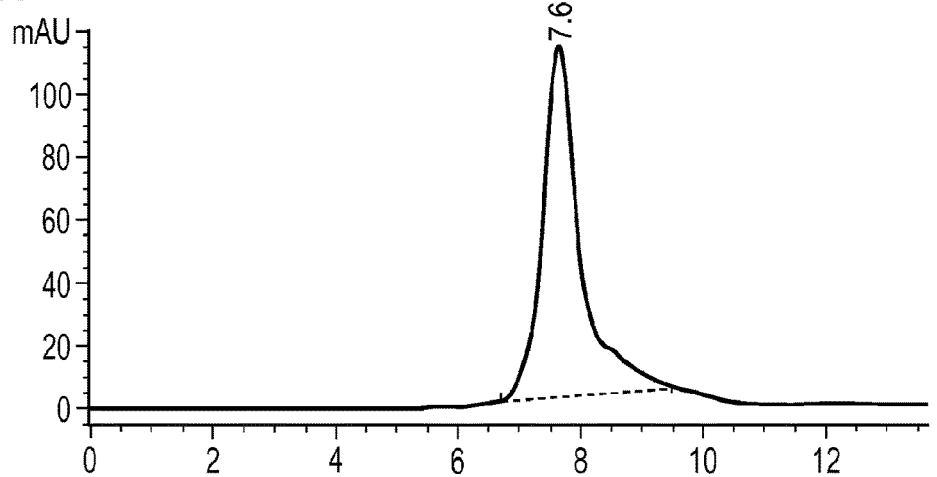
Figure 6:
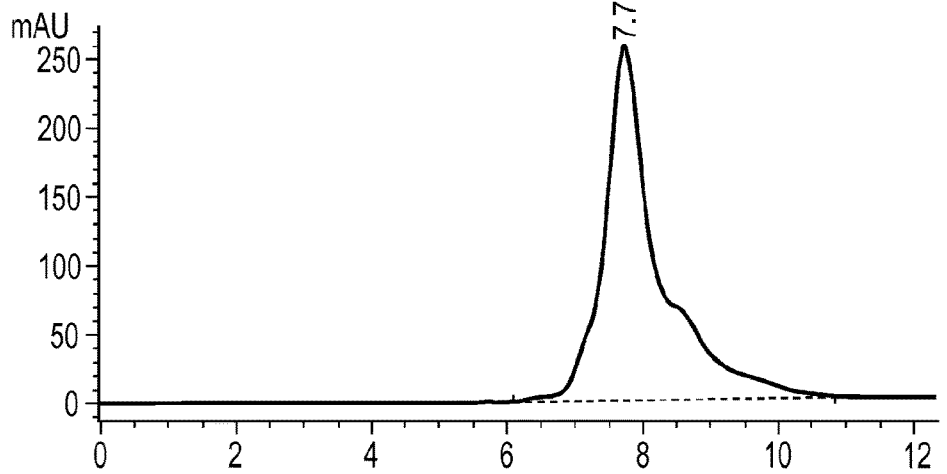
Figure 7:
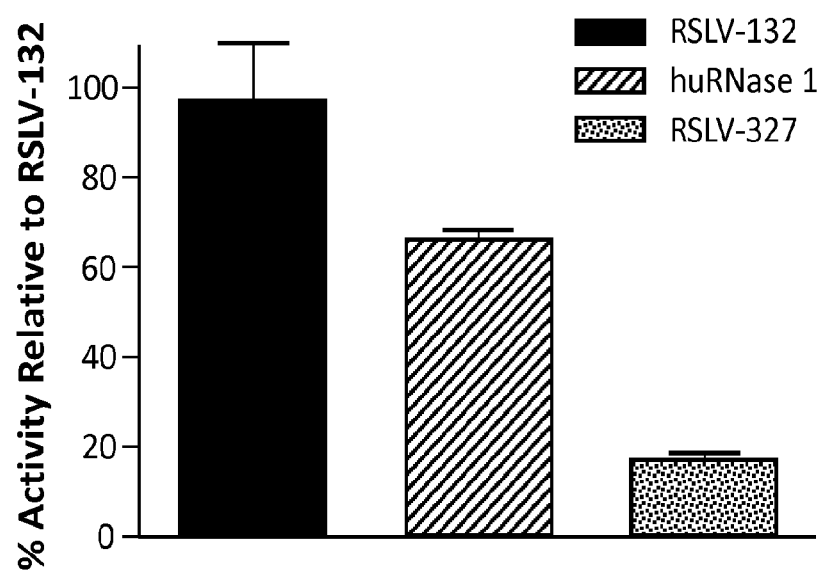
FIG. 7 is a graph depicting RNaseAlert profiling of purified RNase preparations. Equivalent amounts of RSLV-132, human recombinant RNase1, and RSLV-327 were profiled using the RNase Alert substrate and compared to RSLV-132 by extrapolating from a separate standard curve.

To confirm that the purified constructs contained the intended antigenic domains, Western blot analysis was conducted using antibodies specific for HSA, RNase1, and DNase1. 1.5 µg of protein were loaded into each lane and the samples electrophoresed on a 4-20% Tris-Glycine gel under denaturing/non-reducing conditions. Following electrophoresis, proteins were blotted onto nitrocellulose and the blots subsequently quenched by incubation in Odyssey Blocking Buffer for 1 hour. One blot was exposed sequentially to: 1 µg/ml of rabbit anti-RNaseA, 1 to 10,000 dilution of AlexaFluor680-tagged goat anti-rabbit IgG, 1 µg/ml of mouse anti-HSA, and a 1 to 10,000 dilution of DyLight800-tagged goat anti-mouse IgG. The blots were imaged using a Licor Odyssey. When probed with anti-RNase (red fluorescent tag) and anti-HSA (green fluorescent tag), all eight constructs appeared yellow, indicating that both antibodies were binding to the constructs (FIG. 5A). Another blot was exposed sequentially to: 1 µg/ml rabbit anti-DNaseA1, 1 to 10,000 dilution of AlexaFluor680-tagged goat anti-rabbit IgG, 1 µg/ml of mouse anti-HSA, and a 1 to 10,000 dilution of DyLight800-tagged goat anti-mouse IgG. Similarly, when probed with anti-DNase1 (red fluorescent tag) and anti-HSA (green fluorescent tag), all eight constructs again appeared yellow indicating binding of both antibodies (FIG. 5B). Therefore, the 110 kDa purified constructs appear to possess the intended antigenic domains.

HPLC Size Exclusion Chromatography

The chromatographic behavior of three individual RSLV-300 series constructs was assessed by HPLC size exclusion chromatography to provide further insight into purity. A TSK-Gel G300SW$_{XL}$ column (Tosoh Bioscience LLC) was equilibrated in 0.1 M sodium sulfate, 0.1 sodium acetate, pH 6, and eluted at a flow rate of 1 ml/min. Each of the constructs eluted primarily as a single peak with an elution time near 7.6 minutes (FIG. 6). Based on comparison to the elution times of the molecular weight standards, this would equate to an apparent MW between 158 kDa and 330 kDa. The major peak in the RSLV-308 chromatogram (FIG. 6A) was well defined (peak at 7.64 minutes) with several smaller less abundant species also present. In contrast, the major peaks in the RSLV-327 (peak at 7.64 minutes) (FIG. 6B) and RSLV-328 (peak at 7.73 minutes) (FIG. 6C) chromatograms were broader and contained trailing shoulders. The observed retention times fall between the 6.99 minute and 8.12 minute retention times of the IgG (158 kDa) and thyroglobulin monomer (330 kDa) calibration standards (not shown).

Example 4

Nuclease Activity of Purified Hybrid Nuclease-Albumin Molecules

To assess the relative catalytic activity of the nucleases, the constructs were profiled side-by side using either the RNaseAlert® or DNaseAlert® substrate kits. In this analysis, rates of hydrolysis were calculated for each substrate and compared to the activity of RSLV-133, a nuclease fusion construct containing both RNase and DNase. When expressed as a percentage of the RSLV-133 activity, the observed RNase activities of the RSLV-300 series constructs were consistently less, ranging from 15% for RSLV-323 to 31% for RSLV-310 (Table 3). Likewise, the DNase activity of the 300 series constructs consistently read-out less than derived from RSLV-133 (Table 3); the range being 5% for RSLV-310 to 18% for RSLV-319. The two notable exceptions being RSLV-327 and RSLV-328 which yielded DNase activity values 3.3-fold and 6.6-fold, respectively, greater than RSLV-133. RSLV-327 and -328 contain mutations within the DNase domain that are reported to enhance DNase activity. Additionally, RSLV-319 and RSLV-320, both possessing mutations in the RNase domain to reduce N-linked glycosylation, demonstrated RNase activity comparable to their glycoslyated counterparts.

TABLE 3

Comparision of RNase and DNase activites of RSLV-300 constructs using Alert formats

| Construct | % RNase Activity Relative to RSLV-133 | % DNase Activity Relative to RSLV-133 |
|---|---|---|
| RSLV-308 | 25% | 8% |
| RSLV-310 | 31% | 5% |
| RSLV-319 | 20% | 18% |
| RSLV-320 | 25% | 6% |
| RSLV-323 | 15% | 6% |
| RSLV-324 | 16% | 23% |
| RSLV-327 | 18% | 330% |
| RSLV-328 | 24% | 662% |
| RSLV-133 | 100% | 100% |

The HSA constructs consistently appeared less active in the RNaseAlert format than RSLV-132 or RSLV-133. Both the RNase and DNase Alert assay formats employ small oligonucleotide substrates bearing large fluorophores and quenchers at opposite ends of the molecules. While these substrates offer high sensitivity for monitoring activity, their non-physoiological nature may create challenges when comparing different protein constructs. Despite the RNase moiety of RSLV-132 being identical in amino acid sequence to human RNase1, RSLV-132 appears to possess higher RNase catalytic activity as assessed using the RNaseAlert substrate (FIG. 7). Despite RSLV-327 containing the same RNase domain sequence, this construct appears to possess less activity than recombinant RNase1 (FIG. 7). The most likely explanation for this observation is that these apparent differences are not a true reflection of catalytic capacity but, rather, signify differential interactions of the quenched fluorescent oligonucleotides with the various protein constructs. It is likely that binding of these unnatural substrates is highly dependent on charge interactions which will vary with each construct. As shown in Example 7, using a cell based assay format dependent on poly(I:C), the RNase activities of the various constructs appear similar.

Example 5

Rapid Purifaction of RSLV-308

RSLV-300 series constructs lacking the DNase activation mutations consistently showed reduced DNase activity relative to RSLV-133. In the standard purification process, multiple RSLV-300 series constructs were processed in parallel; as such, constructs were often maintained for prolonged time periods at an intermediate state of the purification process. One explanation for the observed lower catalytic activity is that the DNase domain may not be as stable as the RNase domain (for example the DNase domain is known to bind divalent cations) and that the reduced DNase activity of the HSA constructs may reflect differential loss of DNase activity during the purification scheme. To explore this, a single culture harvest of RSLV-308 was prepared and rapidly processed through the 2-step chromatographic purification. Total activity, both RNase and DNase, was calculated based on the amount of activity observed in the crude harvested conditioned medium using the RNaseAlert® and DNaseAlert® formats. At each stage of the subsequent purification, recovery of activity was calculated. As shown in Table 4, the relative recovery of the RNase and DNase activities occurred in parallel. At the end of the purification process, an overall 41% recovery of the RNase activity was achieved with a similar 46% recovery of the DNase activity. Yet, when compared to RSLV-133, the final RSLV-308 preparation contained 50% of the expected RNase activity (based on the hydrolysis of the RNaseAlert substrate normalized to protein) and only 17% of the expected DNase activity (based on rate of hydrolysis of the DNaseAlert substrate normalized to protein). The reduced DNase activity of RSLV-308 relative to RSLV-133 in the absence of a preferential loss of DNase activity during purification suggests that RSLV-308, and by inference, the other RSLV-300 series constructs lacking the DNase activating mutations, inherently possess reduced DNase catalytic activity relative to RSLV-133 as assessed using the quenched fluorescent substrate.

TABLE 4

Activity accounting during RSLV-308 purification

| Fraction | Total RNase Activity | Total DNase Activity |
|---|---|---|
| Conditioned Medium | 100% | 100% |
| Q-SEPHAROSE ™ Flow Through | 0% | 0% |
| Q-SEPHAROSE ™ Wash | 0% | 0% |
| Q-SEPHAROSE ™ Eluate | 66% | 68% |
| Concentrated Q-Eluate | 52% | 68% |
| SUPERDEX ™ 200 Pooled Eluate | 41% | 46% |

Example 6

Linker Domains

RSLV-133 and RSLV-308 are similar in that the RNase and DNase domains are positioned at the N- and C-termini, respectively, of the scaffold domain. Yet, the DNase activity recovered in association with the HSA scaffold (RSLV-308) is less than observed with the Fc scaffold construct (RSLV-133). RSLV-133 is dimeric as a result of the Fc scaffold. Therefore, at the N- and C-termini of RSLV-133 two nuclease domains are juxtapositioned; this arrangement may somehow enhance activity of the DNase domain thus accounting for the higher apparent activity observed for RSLV-133 versus RSLV-308. Another difference between RSLV-133 and RSLV-308 exists in the nature of the linker between DNase domain and the C-terminus of the scaffold. In RSLV-133 the DNase domain is positioned at the C-terminus of the Fc domain via an eighteen amino acid linker sequence composed of: VDGASSPVNVSSPSVQDI (SEQ ID NO: 149). This linker contains a potential site of N-linked glycosylation (NVS sequon). In contrast, in the RSLV-300 series constructs the DNase domain, whether at the N- or C-terminus of the HSA scaffold, is attached via a $(Gly_4S)_3$ (SEQ ID NO: 85) linker which does not contain a site of N-linked glycosylation. The positioning of a linker with a hydrophilic oligosaccharide between the scaffold and DNase domain may provide a domain structure that favors DNase catalytic function. To explore this possibility, an additional 300 series construct was engineered. RSLV-329 is identical to RSLV-327 in that it contains the RNase domain at the N-terminus of the HSA scaffold and the DNase domain, possessing 3 DNase activation mutations, positioned at the C-terminus. However, the linker segment between the HSA scaffold and the DNase domain was changed from $(Gly_4S)_3$ (SEQ ID NO: 85) in RSLV-327 to VDGASSPVNVSSPSVQDI (SEQ ID NO: 149) in RSLV-329.

Figure 8:
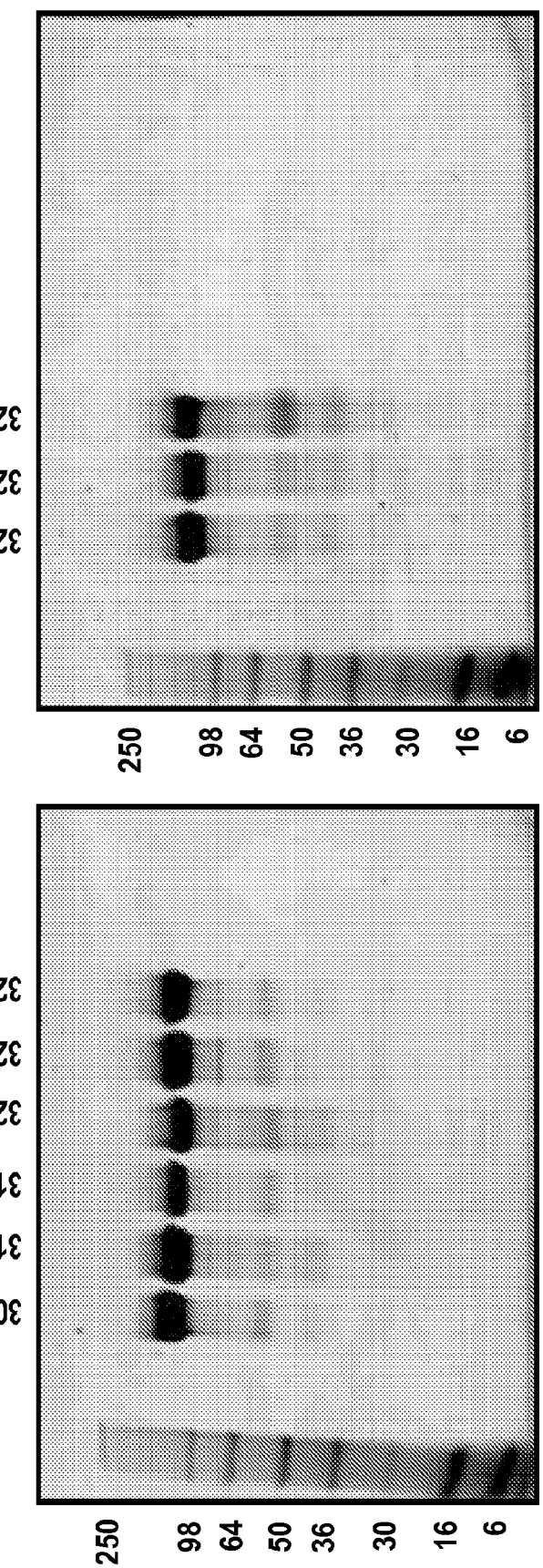
FIG. 8 depicts SDS PAGE analysis of purified RSLV-300 constructs.

CHO-S cells were transfected with the expression vector encoding RSLV-329 and the resulting protein product was isolated using the same 2-step purification scheme described herein. Concentrations of RSLV-300 proteins were determined by $A_{280}$ measurements and samples were diluted to 200 ug/ml with 1× protein loading buffer (Licor Catalog #928-40004) and heat denatured. 6 ug of total protein were loaded into each lane and the samples electrophoresed on a 4-20% Tris-Glycine gel under denaturing conditions. Gels were stained with Simply Blue Safe stain. When analyzed by SDS gel electrophoresis, the RSLV-329 preparation appeared to contain more low MW contaminants than other 300 series constructs but all of the preparations were highly enriched for the 110 kDa species (FIG. 8). When analyzed using the RNaseAlert format, RSLV-329 yielded 29% of the activity observed for RSLV-132. Using the DNaseAlert format, RSLV-329 appeared to possess 266% of the DNase activity associated with RSLV-133, consistent with the presence of the DNase activating mutations.

Example 7

Comparison of RNase and DNase Activity in Cellular Assay Formats

RNase

Figure 9:
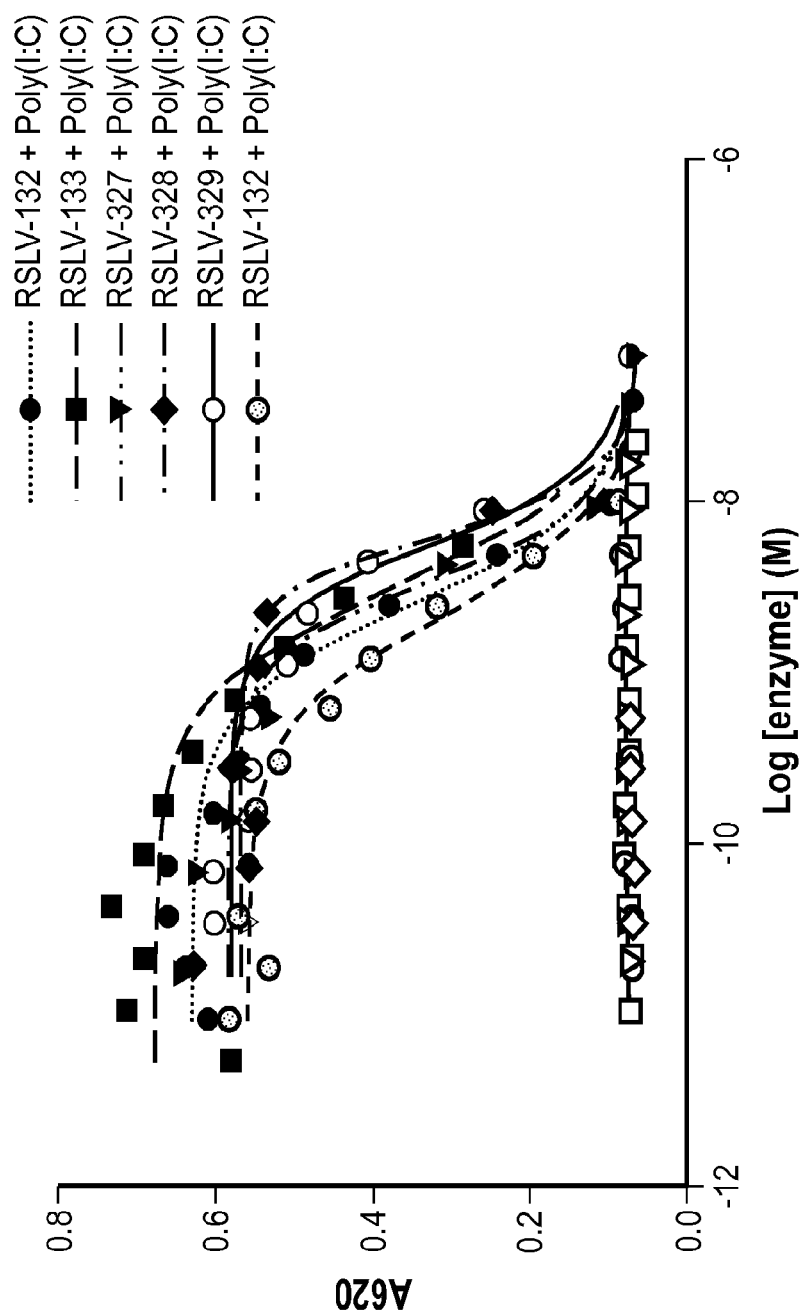
FIG. 9 is a graph depicting the characterization of RNA hydrolytic activity based on inhibition of poly(I:C)-induced activation of hTLR3 HEK Blue cells. The open symbols at the bottom indicate where the various constructs were added to cells in the absence of poly(I:C) (negative controls).

To compare activity using oligonucleotide substrates, selected constructs were profiled for their ability to degrade TLR ligands. When cultured in the presence of an appropriate dsRNA ligand, HEK Blue cells engineered to express human Toll-like receptor 3 (TLR3) secrete alkaline phosphatase (SEAP) that is readily detected in the conditioned medium using a colorometric substrate. TLR3-transfected cells were obtained from Invivogen. Poly(I:C), a synthetic analog of dsRNA, acts as a ligand in this system and was purchased from Invivogen (poly(I:C)-LMW); the $EC_{50}$ for poly(I:C) as an inducer of SEAP in the TLR3 cell assay was determined to be 1.3 ng/ml. SEAP output (measured as absorbance at 620 nm) was assessed from hTLR3 HEK Blue cells stimulated overnight in the presence of 80 ng/ml poly(I:C). The poly(I:C) was pre-incubated with the indicated concentration of an RNase construct for 45 minutes prior to addition of ~50,000 hTLR3 HEK Blue cells to the wells of the 96-well plate. As shown in FIG. 9, pre-incubation of the poly(I:C) ligand with various RSLV constructs caused a concentration-dependent inhibition in the output of SEAP. This is consistent with the RNase activity derived from the constructs being capable of degrading dsRNA. A comparison of the observed $IC_{50}$ values (Table 5) indicates that RSLV-132 and RSLV-133 have comparable RNase activities in this format. Recombinant human RNase1 was also effective at degrading poly(I:C) yielding an $IC_{50}$ value 1.5-fold more potent than RSLV-133 (Table 5). RSLV-308, RSLV-327, RSLV-328, and RSLV-329 yielded slightly higher $IC_{50}$ values suggesting a 1.3-3.3-fold reduction in RNase activity relative to RSLV-133. This apparent reduction may, in part, reflect the lower purity of the 300 series constructs relative to the constructs purified by Protein A affinity chromatography.

Figure 10:
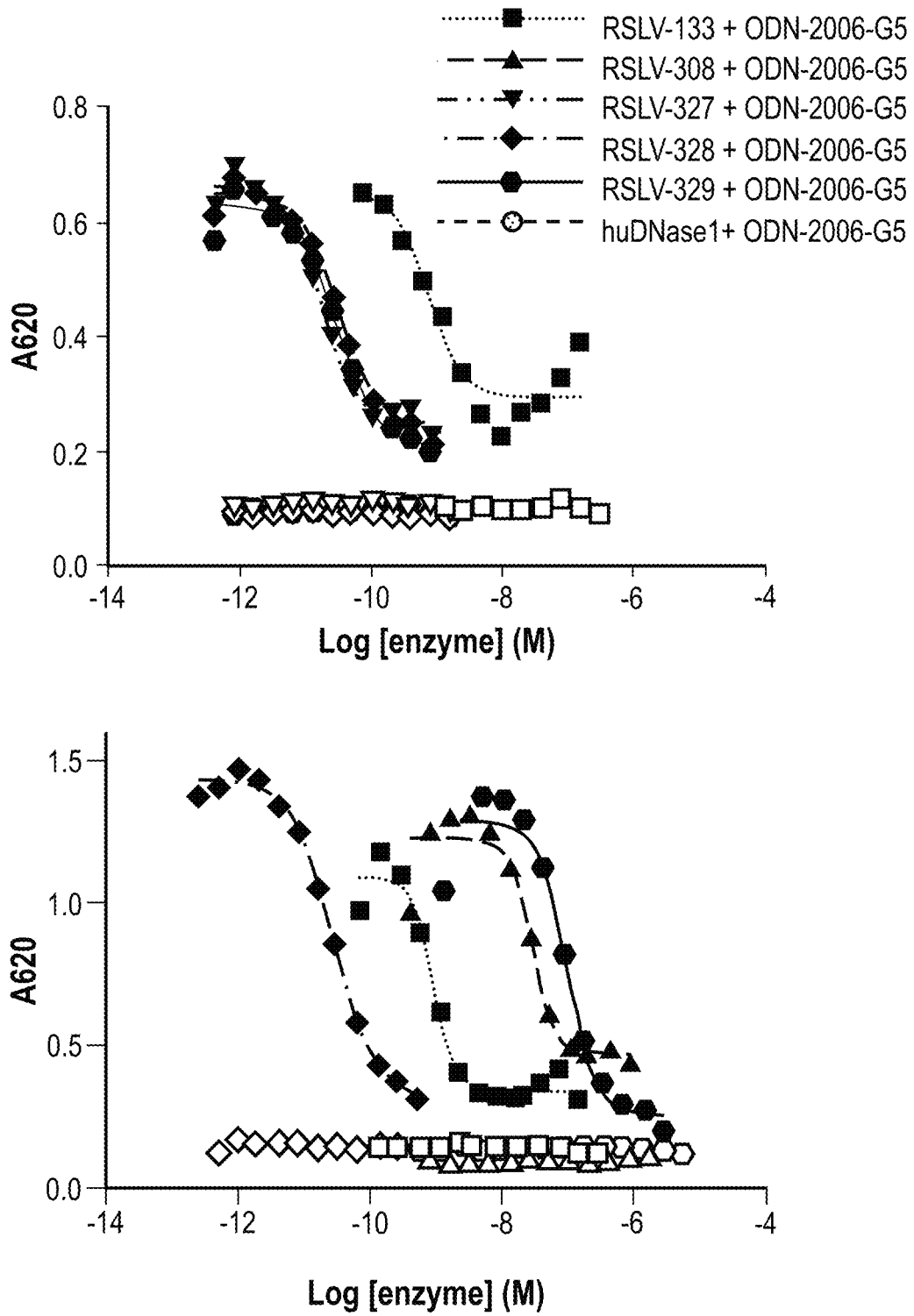
FIG. 10 depicts graphs characterizing DNA hydroylitic activity based on inhibition of ODN-2006-G5-induced activation of hTLR9 HEK Blue cells. The open symbols at the bottom indicate where the various constructs were added to cells in the absence of ODN-2006-G5 (negative controls). The two plots represent experiments conducted on different days.

This data shows that there appears to be flexibility in the positioning of the RNase domain since RNase activity observed for constructs containing the RNase domain at the N-terminus (e.g., RSLV-308) or C-terminus (e.g., RSLV-328) of the HSA scaffold were very similar in potency to RSLV-133. Additionally this assay demonstrated the RNase functionality of RSLV-327, RSLV-328, and RSLV-329 since the poly(I:C) degrading activity was within 2.5-fold of that seen with RSLV-133.

fold less potent than observed for RSLV-133 (Table 6), perhaps suggesting that the dimeric structure of RSLV-133 facilitates hydrolysis of the ODN-2006-G5 substrate relative to the monomeric RSLV-308 and recombinant hDNase constructs. RSLV-327, RSLV-328, and RSLV-329 demonstrated enhanced catalytic activity relative to RSLV-133 (FIG. 10). The observed $IC_{50}$ values for RSLV-327, RSLV-328, and RSLV-329 were $2.35 \times 10^{-11}$, $4.07 \times 10^{-11}$, and $5.58 \times 10^{-11}$, respectively (Table 6). Thus, the activation mutations inserted into the DNase domains of these three constructs increased apparent activity by 42-, 24-, and 17-fold for RSLV-327, RSLV-328, and RSLV-329, respectively, relative

TABLE 5

Comparision of RNase-mediated inhibition of SEAP output from TLR3 HEK Blue cells

| Construct | RSLV-132 | RSLV-133 | RSLV-308 | RSLV-327 | RSLV-328 | RSLV-329 | hRNase |
|---|---|---|---|---|---|---|---|
| Mean $IC_{50}$ | 2.18E−09 | 1.97E−09 | 5.75E−09 | 2.37E−09 | 4.54E−09 | 3.30E−09 | 1.20E−09 |
| N | 8 | 2 | 2 | 4 | 4 | 4 | 2 |
| Sd | 1.09E−09 | 1.67E−09 | 1.31E−09 | 8.97E−10 | 1.27E−09 | 1.66E−09 | 1.27E−11 |
| Potency Relative to RSLV-133 (fold) | 0.8 | 1 | 0.3 | 0.8 | 0.4 | 0.6 | 1.5 |

DNase

DNase activity was compared using HEK Blue cells engineered to express human Toll-like receptor 9 (TLR9) which, like TLR3 HEK Blue cells, secrete SEAP when activated by an appropriate ligand. ODN-2006-G5, a phosphodiester-based oligonucleotide, acts as a ligand in this system and was purchased from Invivogen; the $EC_{50}$ for this oligonucleotide as an inducer of SEAP in the TLR9 cell assay was determined to be 1.26 µM. SEAP output (measured as absorbance at 620 nM) was assessed from hTLR9 HEK Blue cells stimulated overnight in the presence of 2 µM ODN-2006-G5. The deoxyoligonucleotide was pre-incubated with the indicated concentration of a DNase construct for 60 minutes prior to addition of ~80,000 hTLR9 HEK Blue cells to the wells of the 96-well plate. As shown in FIG. 10, pre-incubation of ODN-2006-G5 with recombinant hDNase1 (ProSpec) led to a concentration-dependent inhibition of its SEAP-inducing activity. A second source of recombinant hDNase (Abcam) showed similar concentration-dependent inhibition (data not shown). RSLV-308 was also capable of reducing SEAP output; the $IC_{50}$ values being $3.57 \times 10^{-8}$ M, comparable to $IC_{50}$ value observed for recombinant hDNase preparations (Table 6). The concentration response curve for RSLV-133 was shifted to the left of RSLV-308 and hDNase (FIG. 10). The observed $IC_{50}$ values for RSLV-308 and recombinant hDNase were 33- to 100- to RSLV-133. Similar $IC_{50}$ values were observed for RSLV-327 and RSLV-329 indicating that substitution of the linker domain between the albumin scaffold and the C-terminal DNase domain from (Gly4Ser)3 (SEQ ID NO: 85) as found in RSLV-327 to VDGASSPVNVSSPSVQDI (SEQ ID NO: 149) as found in RSLV-329 did not result in enhanced DNase activity. As such, the reduced DNase activity associated with RSLV-308 and the other constructs lacking the DNase activating mutations relative to RSLV-133 does not appear to be linker-dependent. However, the introduction of the DNase activating mutations into RSLV-300 series constructs (e.g., RSLV-327) gives rise to constructs possessing greater apparent DNase activity than RSLV-133.

TABLE 6

Comparision of DNase-mediated inhibition of SEAP output from TLR9 HEK Blue cells

| Construct | hDNase1* | RSLV-133 | RSLV-308 | RSLV-327 | RSLV-328 | RSLV-329 |
|---|---|---|---|---|---|---|
| Mean $IC_{50}$ | 8.41E−09 | 9.75E−10 | 3.57E−08 | 2.35E−11 | 4.07E−11 | 5.58E−11 |
| N | 8 | 4 | 4 | 4 | 6 | 2 |
| Sd | 1.06E−08 | 4.35E−10 | 2.58E−08 | 8.51E−12 | 1.79E−11 | 3.24E−11 |
| Potency Relative to RSLV-133 (fold) | 0.01 | 1 | 0.03 | 42 | 24 | 17 |

*The commercial rhDNase1 preparations are assumed to correspond to wild-type human DNase1. The DNase domain found in all RSLV constructs contains a point mutation (A114F) which is known to reduce acting binding, an inhibitor of DNase activity. Since the media employed in the cellular experiments contained serum, it is possible that actin was introduced to the digests. As such, the reduced activity of rhDNase relative to RSLV-133 may, in part, stem from inhibition of the rhDNase by actin.

Additional Characterization of Expression

Figure 11:
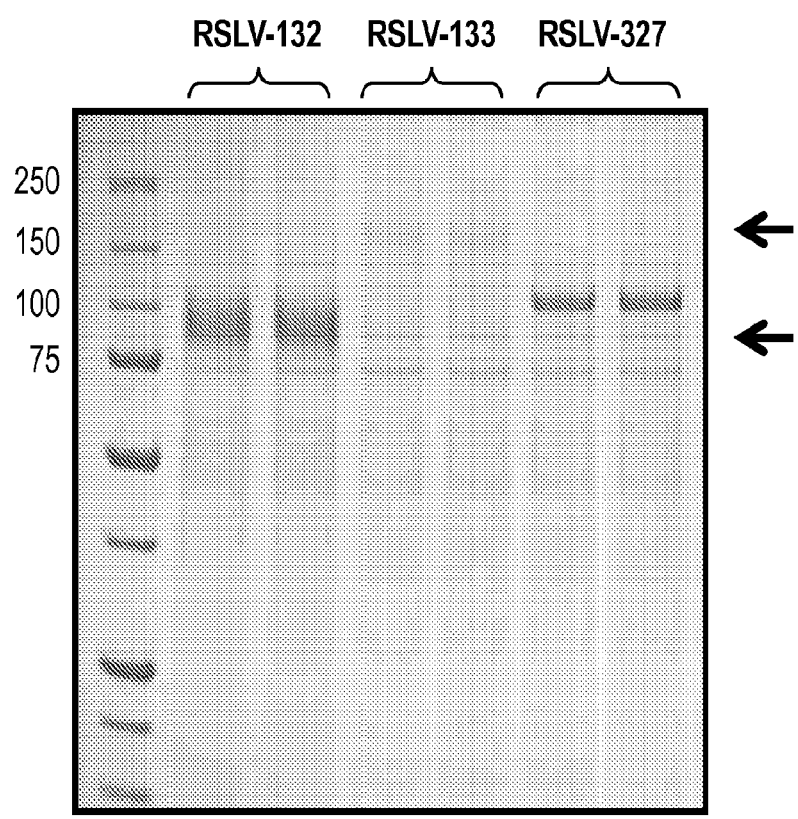
FIG. 11 depicts comparison of expression after transient infection of CHO-3E7 cells with expression vectors encoding RSLV-132, RSLV-133, and RSLV-327, by SDS gel electrophoresis under non-reduction conditions. The two arrows denote expected migration positions for RSLV-132 (bottom) and RSLV-133 (top).

Expression of the 300 series constructs was examined using a transient expression system. CHO-3E7 cell cultures (125 ml) were transfected with vectors encoding RSLV-132, RSLV-133, or RSLV-327; each condition was performed in duplicate to ensure consistency. After 5 days of growth, the culture supernatants were harvested and analyzed by SDS gel electrophoresis. Twenty-five µL of each medium was analyzed under non-reducing conditions and the gel was stained with Coomassie blue to visualize proteins. FIG. 11 indicates that RSLV-132 yielded good expression in this system whereas yields of RSLV-133 were low. RSLV-327 expressed well, with output approaching that observed with RSLV-132.

Figure 12:
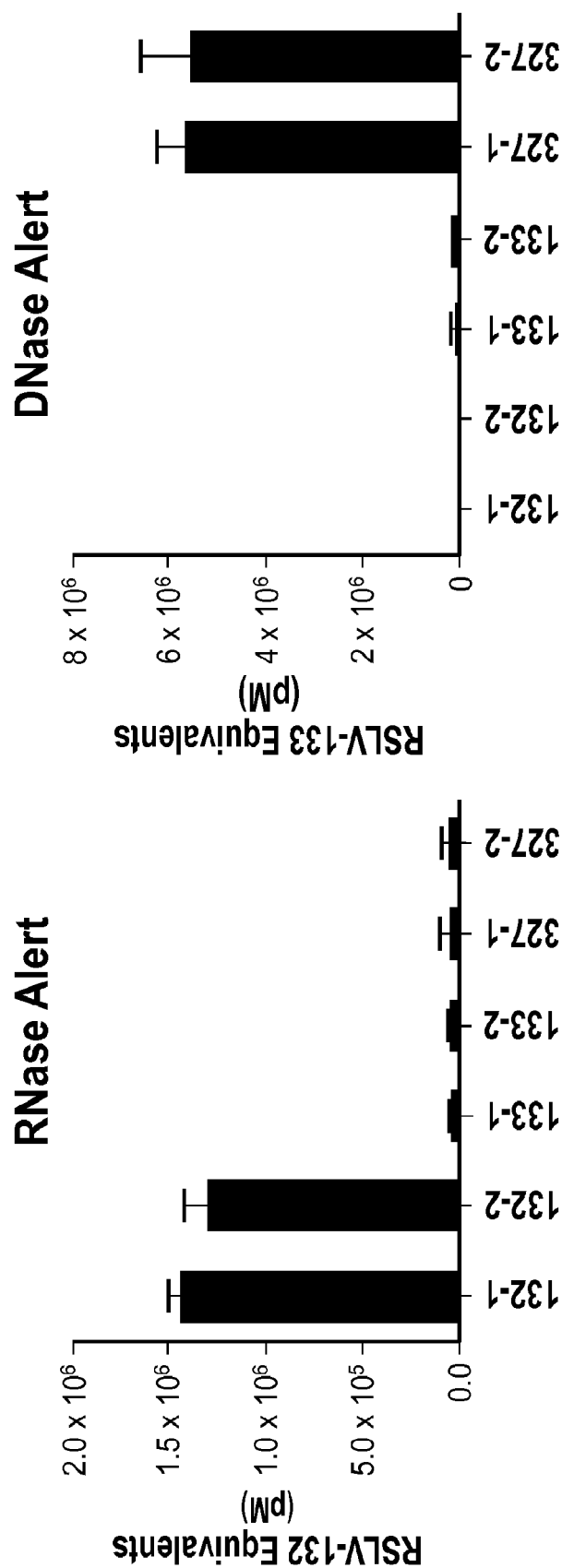
FIG. 12 graphically depicts the assessment of nuclease activity (RNase or DNase) in harvested supernatants. The amount of activity detected in each of the supernatants compared to standard curves generated with purified RSLV-133 is indicated.

To confirm that the CHO-3E7 cell products possessed nuclease activity, aliquots of the media were profiled using the RNase and DNase Alert formats. As shown in FIG. 12 and in Table 7, supernatants harvested from the RSLV-132 transfectants demonstrated robust RNase activity but no DNase activity; absence of the latter is expected as RSLV-132 contains only an RNase moiety. Supernatants derived from the RSLV-133 transfectants demonstrated low RNase and DNase activities; this is consistent with the low expression observed with this construct (FIG. 11). Supernatants derived from the RSLV-327 transfectants showed low RNase activity relative to the RSLV-132 culture supernatants, but very robust DNase activity. The low RNase activity of RSLV-327 relative to RSLV-132 in the RNase Alert format is attributed to the quenched fluorescent substrate as noted above. As such, the activity profiles observed in the conditioned media were consistent with the expression levels observed by SDS gel electrophoresis. Therefore, when transiently expressed in CHO-3E7 cells, RSLV-327 is expressed at significantly higher levels than RSLV-133 and approaching levels achieved by RSLV-132.

TABLE 7

Nuclease activity observed in conditioned media derived from CHO-3E7 cells transiently expressing RSLV constructs

| Construct | RNase Activity (nM) | DNase Activity (nM) |
| --- | --- | --- |
| RSLV-132-1 | 1459 | 0.099 |
| RSLV-132-2 | 1314 | 0.086 |
| RSLV-133-1 | 52 | 165 |
| RSLV-133-2 | 62 | 216 |
| RSLV-327-1 | 71 | 5735 |
| RSLV-327-2 | 75 | 5620 |

Example 8

Half-Life of Hybrid Nuclease-Albumin Molecules in Cynomolgus Monkeys

Cynomolgus monkeys are intravenously injected with a single injection of a hybrid nuclease-albumin molecule of Example 2 at time zero. Blood sample are collected at several time points post-injection (e.g., every day over the course of seven days) and analyzed for the presence of the hybrid nuclease-albumin molecules. The hybrid nuclease-albumin molecules can be detected with standard ELISA format assays which capture human HSA from monkey serum, followed by detection of human RNase1 or human DNase1. The same blood samples can be used to measure the enzymatic activity (i.e., the nuclease activity) of the hybrid nuclease-albumin molecules using commercially available kits (e.g., RNaseAlert™ QC system, Ambion; DNaseAlert™ QC System, Invitrogen; DNase ELISA kit, Abnova; ORG 590 DNase Activity, ORGENTEC Diagnostika GmbH), following the manufacturers' instructions.

Example 9

Efficacy of Hybrid Nuclease-Albumin Molecules In Vitro

Effects of Hybrid Nuclease-Albumin Molecules on Cytokine Expression

Human PBMCs are isolated from healthy volunteers and lupus patients and cultured. The cells are treated with various stimulatory TLR ligands, costimulatory antibodies, immune complexes, and normal or autoimmune sera, with or without the hybrid nuclease-albumin molecules of Example 2. Culture supernatant is collected at various time points (e.g., 6 hrs, 12 hrs, 24 hrs, 48 hrs, etc) and levels of a panel of cytokines, including human IL-6, IL-8, IL-10, IL-4, IFN-gamma, IFN-alpha and TNF-alpha are measured using commercially available ELISA kits from, e.g., Thermo Fisher Scientific, Inc. Effective hybrid nuclease-albumin molecules are expected to reduce the levels of cytokines produced by stimulated PBMCs relative to controls.

Effects of Hybrid Nuclease-Albumin Molecules on Lymphocyte Activation Receptor Expression Human PBMCs are isolated from healthy volunteers and lupus patients and subsequently cultured. The cells are treated with various stimulatory TLR ligands, costimulatory antibodies, immune complexes, and normal or autoimmune sera, with or without the hybrid nuclease-albumin molecules of Example 2. Cells are then subjected to multi-color flow cytometry to measure the expression of lymphocyte activation receptors CD5, CD23, CD69, CD80, CD86, and CD25 at various time points (e.g., 6 hrs, 12 hrs, 24 hrs, 48 hrs, etc.) after stimulation using routine art-recognized methods. Suitable antibodies for these receptors are commercially available from, e.g., BD/PharMingen. Effective hybrid nuclease-albumin molecules are expected to reduce the expression of the lymphocyte activation receptors in stimulated PBMCs relative to controls.

Effects of Hybrid Nuclease-Albumin Molecules on Plasmacytoid Dendritic Cell (pDC) Interferon Output pDCs from healthy volunteers are isolated using art-recognized methods or commercially available kits, such as the EasySep™ Human EpCAM Positive Selection Kit (StemCell Technologies, Inc.). Isolated pDCs are cultured in, e.g., 96-well flat-bottom plates, at a densities ranging from $5\times10^4$ to $2.5\times10^5$/well in 0.1 ml in an appropriate medium (e.g., complete RPMI medium containing 10% FBS, 2 mM glutamine, 55 µM β-mercaptoethanol, 1 mM sodium pyruvate, 100 U/ml penicillin, and 100 µg/ml streptomycin). Cultured pDCs are activated by adding sera or plasma from individual SLE patients diluted with culture medium at a 1:5 ratio, and 0.1 ml of these samples are added to the cell-containing wells (final patient serum concentration is 10%). Cultures are incubated at 37° C. for 40 hr, after which the conditioned media is harvested and assessed for IFNα content using a commercially available ELISA kit. Serum samples obtained from healthy volunteers are used as controls. To assess the impact of the hybrid nuclease-albumin constructs, SLE patient sera or plasma is pretreated with the hybrid nuclease-albumin constructs (1-10 µg/ml) for 30 min and added to the pDC cultures. Effective hybrid nuclease-albumin molecules are expected to reduce the quantity of IFNα produced as a result of degrading the nucleic acid-containing ICs.

* * *

While the invention has been particularly shown and described with reference to a preferred embodiment and various alternate embodiments, it will be understood by persons skilled in the relevant art that various changes in form and details can be made therein without departing from the spirit and scope of the invention.

All references, issued patents and patent applications cited within the body of the instant specification are hereby incorporated by reference in their entirety, for all purposes.

SEQUENCE LISTING (149 sequences)

SEQ ID NO: 1 - protein, 585 aa, Homo sapiens [sequence omitted]

SEQ ID NO: 2 - protein, 621 aa, Pan troglodytes
  misc_feature (1)..(621): Chimpanzee serum albumin (precursor)
MNESSCCSTSLPAFGVSVLDSGHSSSSAYSRGVFRRDAHKSEVAHRFKDLGEENFKALVLVAFAQYLQQCPFEDHVKLVNEVTEFAKTCVADESAENCDKSLHTLFGDKLCTVATLREKYGEMADCCAKQEPERNECFLQHKDDNPNLPRLVRPEVDVMCTAFHDNEGTFLKKYLYEVARRHPYFYAPELLFFAERYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCLAEVENDEMPADLPSLAADFVESKEVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 3 - protein, 608 aa, Macaca sp.
  misc_feature (1)..(608): Macaque serum albumin
MKWVTFISLLFLFSSAYSRGVFRRDTHKSEVAHRFKDLGEEHFKGLVLVAFSQYLQQCPFEEHVKLVNEVTEFAKTCVADESAENCDKSLHTLFGDKLCTVATLRETYGEMADCCAKQEPERNECFLQHKDDNPNLPPLVRPEVDVMCTAFHDNEATFLKKYLYEVARRHPYFYAPELLFFAARYKAAFAECCQAADKAACLLPKLDELRDEGKASSAKQRLKCASLQKFGDRAFKAWAVARLSQKFPKAEFAEVSKLVTDLTKVHTECCHGDLLECADDRADLAKYMCENQDSISSKLKECCDKPLLEKSHCLAEVENDEMPADLPSLAADYVESKDVCKNYAEAKDVFLGMFLYEYARRHPDYSVMLLLRLAKAYEATLEKCCAAADPHECYAKVFDEFQPLVEEPQNLVKQNCELFEQLGEYKFQNALLVRYTKKVPQVSTPTLVEVSRNLGKVGAKCCKLPEAKRMPCAEDYLSVVLNRLCVLHEKTPVSEKVTKCCTESLVNRRPCFSALELDEAYVPKAFNAETFTFHADMCTLSEKEKQVKKQTALVELVKHKPKATKEQLKGVMDNFAAFVEKCCKADDKEACFAEEGPKFVAASQAALA

SEQ ID NO: 4 - protein, 608 aa, Cricetulus griseus
  misc_feature (1)..(608): Hamster serum albumin
MKWVTFLLLLFVSDSAFSRGLFRRDAHKSEIAHRFKDLGEQHFKGLVLIAFSQFLQKCPYEEHVKLVNEVTDFAKTCVADESAENCDKSLHTLFGDKLCAIPTLRDSYGELADCCAKKEPERNECFLKHKDDHPNLPPFVRPDAEAMCTSFQENAVTFMGHYLHEVARRHPYFYAPELLYYAEKYSAIMTECCGEADKAACITPKLDALKEKALASSVNQRLKCSSLQRFGQRAFKAWAVARMSQKFPKADFAEITKLATDLTKLTEECCHGDLLECADDRAELAKYMCENQASISSKLQACCDKPVLKKSHCLSEVENDDLPADLPSLAADFVEDKEVCKNYAEAKDVFLGTFLYEYARRHPDYSVALLLRLAKKYEATLEKCCAEADPSACYGKVLDEFQPLVEEPKNLVKANCELFEKLGEYGFQNALIVRYTQKAPQVSTPTLVEAARNLGKVGSKCCVLPEAQRLPCVEDYISAILNRVCVLHEKTPVSEQVTKCCTGSVVERRPCFSALPVDETYVPKEFKAETFTFHADICSLPEKEKQMKKQAALVELVKHKPKATGPQLRTVLGEFTAFLDKCCKAEDKEACFSEDGPKLVASSQAALA

SEQ ID NO: 5 - protein, 608 aa, Cavia porcellus
  misc_feature (1)..(608): Guinea pig serum albumin
MKWVTFISLLFLFSSVYSRGVFRREAHKSEIAHRFNDLGEGHFKGLVLITLSQHLQKSPFEEHVKLVNEVTDFAKACVADESAQNCGKAIATLFGDKVCAIPSLRETYGELADCCAKEDPDRVECFLQHKDDNPNLPPFERPEPEALCTAFKENNDRFIGHYLYEVSRRHPYFYAPELLYYAEKYKNALTECCEAADKAACLTPKLDAIKEKALVSSAQQRLKCASLQKFGERAFKAWSVARLSQKFPKAEFAEISTIVTSLTKVTKECCHGDLLECADDRQELAKYMCEHQDSISSKLKECCVKPTLQKAHCILEIQRDELPTELPDLAVDFVEDKEVCKNFAEAKDVFLGTFLYEYSRRHPEYSIGMLLRIAKGYEAKLEKCCAEADPHACYAKVFDELQPLIDEPKKLVQQNCELFDKLGEYGFQNALAVRYTQKAPQVSTPTLVEYARKLGSVGTKCCSLPETERLSCTENYLALILNRLCILHEKTPVSERVTKCCTESLVNRRPCFSALHVDETYVPKPFHADSFTFHADICTLPEKEKQVKKQMALVELVKHKPKASEEQMKTVMGDFAAFLKKCCDADNKEACFTEDGPKLVAKCQATLA

SEQ ID NO: 6 - protein, 608 aa, Mus musculus
  misc_feature (1)..(608): Mouse serum albumin
MKWVTFLLLLFVSGSAFSRGVFRREAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALA

SEQ ID NO: 7 - protein, 608 aa, Rattus norvegicus
  misc_feature (1)..(608): Rat serum albumin
MKWVTFLLLLFISGSAFSRGVFRREAHKSEIAHRFKDLGEQHFKGLVLIAFSQYLQKCPYEEHIKLVQEVTDFAKTCVADENAENCDKSIHTLFGDKLCAIPKLRDNYGELADCCAKQEPERNECFLQHKDDNPNLPPFQRPEAEAMCTSFQENPTSFLGHYLHEVARRHPYFYAPELLYYAEKYNEVLTQCCTESDKAACLTPKLDAVKEKALVAAVRQRMKCSSMQRFGERAFKAWAVARMSQRFPNAEFAEITKLATDLTKINKECCHGDLLECADDRAELAKYMCENQATISSKLQACCDKPVLQKSQCLAEIEHDNIPADLPSIAADFVEDKEVCKNYAEAKDVFLGTFLYEYSRRHPDYSVSLLLRLAKKYEATLEKCCAEGDPPACYGTVLAEFQPLVEEPKNLVKTNCELYEKLGEYGFQNAILVRYTQKAPQVSTPTLVEAARNLGRVGTKCCTLPEAQRLPCVEDYLSAILNRLCVLHEKTPVSEKVTKCCSGSLVERRPCFSALTVDETYVPKEFKAETFTFHSDICTLPDKEKQIKKQTALAELVKHKPKATEDQLKTVMGDFAQFVDKCCKAADKDNCFATEGPNLVARSKEALA

SEQ ID NO: 8 - protein, 607 aa, Bos taurus
  misc_feature (1)..(607): Cow serum albumin
MKWVTFISLLLLFSSAYSRGVFRRDTHKSEIAHRFKDLGEEHFKGLVLIAFSQYLQQCPFDEHVKLVNELTEFAKTCVADESHAGCEKSLHTLFGDELCKVASLRETYGDMADCCEKQEPERNECFLSHKDDSPDLPKLKPDPNTLCDEFKADEKKFWGKYLYEIARRHPYFYAPELLYYANKYNGVFQECCQAEDKGACLLPKIETMREKVLTSSARQRLRCASIQKFGERALKAWSVARLSQKFPKAEFVEVTKLVTDLTKVHKECCHGDLLECADDRADLAKYICDNQDTISSKLKECCDKPLLEKSHCIAEVEKDAIPENLPPLTADFAEDKDVCKNYQEAKDAFLGSFLYEYSRRHPEYAVSVLLRLAKEYEATLEECCAKDDPHACYSTVFDKLKHLVDEPQNLIKQNCDQFEKLGEYGFQNALIVRYTRKVPQVSTPTLVEVSRSLGKVGTRCCTKPESERMPCTEDYLSLILNRLCVLHEKTPVSEKVTKCCTESLVNRRPCFSALTPDETYVPKAFDEKLFTFHADICTLPDTEKQIKKQTALVELLKHKPKATEEQLKTVMENFVAFVDKCCAADDKEACFAVEGPKLVVSTQTALA

SEQ ID NO: 9 - protein, 607 aa, Equus caballus
  misc_feature (1)..(607): Horse serum albumin
MKWVTFVSLLFLFSSAYSRGVLRRDTHKSEIAHRFNDLGEKHFKGLVLVAFSQYLQQCPFEDHVKLVNEVTEFAKKCAADESAENCDKSLHTLFGDKLCTVATLRATYGELADCCEKQEPERNECFLTHKDDHPNLPKLKPEPDAQCAAFQEDPDKFLGKYLYEVARRHPYFYGPELLFHAEEYKADFTECCPADDKLACLIPKLDALKERILLSSAKERLKCSSFQNFGERAVKAWSVARLSQKFPKADFAEVSKIVTDLTKVHKECCHGDLLECADDRADLAKYICEHQDSISGKLKACCDKPLLQKSHCIAEVKEDDLPSDLPALAADFAEDKEICKHYKDAKDVFLGTFLYEYSRRHPDYSVSLLLRIAKTYEATLEKCCAEADPPACYRTVFDQFTPLVEEPKSLVKKNCDLFEEVGEYDFQNALIVRYTKKAPQVSTPTLVEIGRTLGKVGSRCCKLPESERLPCSENHLALALNRLCVLHEKTPVSEKITKCCTDSLAERRPCFSALELDEGYVPKEFKAETFTFHADICTLPEDEKQIKKQSALAELVKHKPKATKEQLKTVLGNFSAFVAKCCGREDKEACFAEEGPKLVASSQLALA

SEQ ID NO: 10 - protein, 607 aa, Equus asinus
  misc_feature (1)..(607): Donkey serum albumin
MKWVTFVSLLFLFSSAYFRGVLRRDTHKSEIAHRFNDLGEKHFKGLVLVAFSQYLQQCPFEDHVKLVNEVTEFAKKCAADESAENCDKSLHTLFGDKLCTVATLRATYGELADCCEKQEPERNECFLTHKDDHPNLPKLKPEPDAQCAAFQEDPDKFLGKYLYEVARRHPYFYGPELLFHAEEYKADFTECCPADDKAGCLIPKLDALKERILLSSAKERLKCSSFQKFGERAFKAWSVARLSQKFPKADFAEVSKIVTDLTKVHKECCHGDLLECADDRADLTKYICEHQDSISGKLKACCDKPLLQKSHCIAEVKEDDLPSDLPALAADFAEDKEICKHYKDAKDVFLGTFLYEYSRRHPDYSVSLLLRIAKTYEATLEKCCAEADPPACYATVFDQFTPLVEEPKSLVKKNCDLFEEVGEYDFQNALIVRYTKKAPQVSTPTLVEIGRTLGKVGSRCCKLPESERLPCSENHLALALNRLCVLHEKTPVSEKITKCCTDSLAERRPCFSALELDEGYIPKEFKAETFTFHADICTLPEDEKQIKKQSALAELVKHKPKATKEQLKTVLGNFSAFVAKCCGAEDKEACFAEEGPKLVASSQLALA

SEQ ID NO: 11 - protein, 608 aa, Oryctolagus cuniculus
  misc_feature (1)..(608): Rabbit serum albumin
MKWVTFISLLFLFSSAYSRGVFRREAHKSEIAHRFNDVGEEHFIGLVLITFSQYLQKCPYEEHAKLVKEVTDLAKACVADESAANCDKSLHDIFGDKICALPSLRDTYGDVADCCEKKEPERNECFLHHKDDKPDLPPFARPEADVLCKAFHDDEKAFFGHYLYEVARRHPYFYAPELLYYAQKYKAILTECCEAADKGACLTPKLDALEGKSLISAAQERLRCASIQKFGDRAYKAWALVRLSQRFPKADFTDISKIVTDLTKVHKECCHGDLLECADDRADLAKYMCEHQETISSHLKECCDKPILEKAHCIYGLHNDETPAGLPAVAEEFVEDKDVCKNYEEAKDLFLGKFLYEYSRRHPDYSVVLLLRLGKAYEATLKKCCATDDPHACYAKVLDEFQPLVDEPKNLVKQNCELYEQLGDYNFQNALLVRYTKKVPQVSTPTLVEISRSLGKVGSKCCKHPEAERLPCVEDYLSVVLNRLCVLHEKTPVSEKVTKCCSESLVDRRPCFSALGPDETYVPKEFNAETFTFHADICTLPETERKIKKQTALVELVKHKPHATNDQLKTVVGEFTALLDKCCSAEDKEACFAVEGPKLVESSKATLG

SEQ ID NO: 12 - protein, 583 aa, Capra hircus
  misc_feature (1)..(583): Goat serum albumin
DTHKSEIAHRFNDLGEENFQGLVLIAFSQYLQQCPFDEHVKLVKELTEFAKTCVADESHAGCDKSLHTLFGDELCKVATLRETYGDMADCCEKQEPERNECFLKHKDDSPDLPKLKPEPDTLCAEFKADEKKFWGKYLYEVARRHPYFYAPELLYYANKYNGVFQECCQAEDKGACLLPKIETMREKVLASSARQRLRCASIQKFGERALKAWSVARLSQKFPKADFTDVTKIVTDLTKVHKECCHGDLLECADDRADLAKYICDHQDTLSSKLKECCDKPVLEKSHCIAEIDKDAVPENLPPLTADFAEDKEVCKNYQEAKDVFLGSFLYEYSRRHPEYAVSVLLRLAKEYEATLEDCCAKEDPHACYATVFDKLKHLVDEPQNLIKKNCELFEKHGEYGFQNALIVRYTRKAPQVSTPTLVEISRSLGKVGTKCCAKPESERMPCTEDYLSLILNRLCVLHEKTPVSEKVTKCCTESLVNRRPCFSDLTLDETYVPKPFDGESFTFHADICTLPDTEKQIKKQTALVELLKHKPKATDEQLKTVMENFVAFVDKCCAADDKEGCFLLEGPKLVASTQAALA

SEQ ID NO: 13 - protein, 607 aa, Ovis aries
  misc_feature (1)..(607): Sheep serum albumin
MKWVTFISLLLLFSSAYSRGVFRRDTHKSEIAHRFNDLGEENFQGLVLIAFSQYLQQCPFDEHVKLVKELTEFAKTCVADESHAGCDKSLHTLFGDELCKVATLRETYGDMADCCEKQEPERNECFLNHKDDSPDLPKLKPEPDTLCAEFKADEKKFWGKYLYEVARRHPYFYAPELLYYANKYNGVFQECCQAEDKGACLLPKIDAMREKVLASSARQRLRCASIQKFGERALKAWSVARLSQKFPKADFTDVTKIVTDLTKVHKECCHGDLLECADDRADLAKYICDHQDALSSKLKECCDKPVLEKSHCIAEVDKDAVPENLPPLTADFAEDKEVCKNYQEAKDVFLGSFLYEYSRRHPEYAVSVLLRLAKEYEATLEDCCAKEDPHACYATVFDKLKHLVDEPQNLIKKNCELFEKHGEYGFQNALIVRYTRKAPQVSTPTLVEISRSLGKVGTKCCAKPESERMPCTEDYLSLILNRLCVLHEKTPVSEKVTKCCTESLVNRRPCFSDLTLDETYVPKPFDEKFFTFHADICTLPDTEKQIKKQTALVELLKHKPKATDEQLKTVMENFVAFVDKCCAADDKEGCFVLEGPKLVASTQAALA

SEQ ID NO: 14 - protein, 608 aa, Canis lupus familiaris
  misc_feature (1)..(608): Dog serum albumin
MKWVTFISLFFLFSSAYSRGLVRREAYKSEIAHRYNDLGEEHFRGLVLVAFSQYLQQCPFEDHVKLAKEVTEFAKACAAEESGANCDKSLHTLFGDKLCTVASLRDKYGDMADCCEKQEPDRNECFLAHKDDNPGFPPLVAPEPDALCAAFQDNEQLFLGKYLYEIARRHPYFYAPELLYYAQQYKGVFAECCQAADKAACLGPKIEALREKVLLSSAKERFKCASLQKFGDRAFKAWSVARLSQRFPKADFAEISKVVTDLTKVHKECCHGDLLECADDRADLAKYMCENQDSISTKLKECCDKPVLEKSQCLAEVERDELPGDLPSLAADFVEDKEVCKNYQEAKDVFLGTFLYEYARRHPEYSVSLLLRLAKEYEATLEKCCATDDPPTCYAKVLDEFKPLVDEPQNLVKTNCELFEKLGEYGFQNALLVRYTKKAPQVSTPTLVEVSRKLGKVGTKCCKKPESERMSCAEDFLSVVLNRLCVLHEKTPVSERVTKCCSESLVNRRPCFSGLEVDETYVPKEFNAETFTFHADLCTLPEAEKQVKKQTALVELLKHKPKATDEQLKTVMGDFGAFVEKCCAAENKEGCFSEEGPKLVAAAQAALV

SEQ ID NO: 15 - protein, 615 aa, Gallus gallus
  misc_feature (1)..(615): Chicken serum albumin
MKWVTLISFIFLFSSATSRNLQRFARDAEHKSEIAHRYNDLKEETFKAVAMITFAQYLQRCSYEGLSKLVKDVVDLAQKCVANEDAPECSKPLPSIILDEICQVEKLRDSYGAMADCCSKADPERNECFLSFKVSQPDFVQPYQRPASDVICQEYQDNRVSFLGHFIYSVARRHPFLYAPAILSFAVDFEHALQSCCKESDVGACLDTKEIVMREKAKGVSVKQQYFCGILKQFGDRVFQARQLIYLSQKYPKAPFSEVSKFVHDSIGVHKECCEGDMVECMDDMARMMSNLCSQQDVFSGKIKDCCEKPIVERSQCIMEAEFDEKPADLPSLVEKYIEDKEVCKSFEAGHDAFMAEFVYEYSRRHPEFSIQLIMRIAKGYESLLEKCCKTDNPAECYANAQEQLNQHIKETQDVVKTNCDLLHDHGEADFLKSILIRYTKKMPQVPTDLLLETGKKMTTIGTKCCQLGEDRRMACSEGYLSIVIHDTCRKQETTPINDNVSQCCSQLYANRRPCFTAMGVDTKYVPPPFNPDMFSFDEKLCSAPAEEREVGQMKLLINLIKRKPQMTEEQIKTIADGFTAMVDKCCKQSDINTCFGEEGANLIVQSRATLGIGA

SEQ ID NO: 16 - protein, 607 aa, Sus scrofa
  misc_feature (1)..(607): Pig serum albumin
MKWVTFISLLFLFSSAYSRGVFRRDTYKSEIAHRFKDLGEQYFKGLVLIAFSQHLQQCPYEEHVKLVREVTEFAKTCVADESAENCDKSIHTLFGDKLCAIPSLREHYGDLADCCEKEEPERNECFLQHKNDNPDIPKLKPDPVALCADFQEDEQKFWGKYLYEIARRHPYFYAPELLYYAIIYKDVFSECCQAADKAACLLPKIEHLREKVLTSAAKQRLKCASIQKFGERAFKAWSLARLSQRFPKADFTEISKIVTDLAKVHKECCHGDLLECADDRADLAKYICENQDTISTKLKECCDKPLLEKSHCIAEAKRDELPADLNPLEHDFVEDKEVCKNYKEAKHVFLGTFLYEYSRRHPDYSVSLLLRIAKIYEATLEDCCAKEDPPACYATVFDKFQPLVDEPKNLIKQNCELFEKLGEYGFQNALIVRYTKKVPQVSTPTLVEVARKLGLVGSRCCKRPEEERLSCAEDYLSLVLNRLCVLHEKTPVSEKVTKCCTESLVNRRPCFSALTPDETYKPKEFVEGTFTFHADLCTLPEDEKQIKKQTALVELLKHKPHATEEQLRTVLGNFAAFVQKCCAAPDHEACFAVEGPKFVIEIRGILA

SEQ ID NO: 17 - protein, 365 aa, Homo sapiens
  misc_feature (1)..(365): Human FcRn
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 18 - protein, 733 aa, Artificial Sequence
  Synthetic RSLV-301 (HSA-RNase)
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 19 - protein, 733 aa, Artificial Sequence
  Synthetic RSLV-302 (RNase-HSA)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 20 - protein, 748 aa, Artificial Sequence
  Synthetic RSLV-303 (HSA-linker-RNase)
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 21 - protein, 748 aa, Artificial Sequence
  Synthetic RSLV-304 (RNase-linker-HSA)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 22 - protein, 861 aa, Artificial Sequence
  Synthetic RSLV-305 (RNase-HSA-RNase)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 23 - protein, 891 aa, Artificial Sequence
  Synthetic RSLV-306 (RNase-linker-HSA-linker-RNase)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 24 - protein, 993 aa, Artificial Sequence
  Synthetic RSLV-307 (RNase-HSA-DNase A114F)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 25 - protein, 1023 aa, Artificial Sequence
  Synthetic RSLV-308 (RNase-linker-HSA-linker-DNase A114F)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 26 - protein, 993 aa, Artificial Sequence
  Synthetic RSLV-309 (DNase A114F-HSA-RNase)
METPAQLLFLLLLWLPDTTGLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 27 - protein, 1023 aa, Artificial Sequence
  Synthetic RSLV-310 (DNase1 A114F-linker-HSA-linker-RNase1)
METPAQLLFLLLLWLPDTTGLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 28 - protein, 865 aa, Artificial Sequence
  Synthetic RSLV-311 (DNase A114F-HSA)
METPAQLLFLLLLWLPDTTGLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 29 - protein, 865 aa, Artificial Sequence
  Synthetic RSLV-312 (HSA-DNase A114F)
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 30 - protein, 880 aa, Artificial Sequence
  Synthetic RSLV-313 (DNase A114F-linker-HSA)
METPAQLLFLLLLWLPDTTGLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 31 - protein, 880 aa, Artificial Sequence
  Synthetic RSLV-314 (HSA-linker-DNase A114F)
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 32 - protein, 748 aa, Artificial Sequence
  Synthetic RSLV-315 (RNase I N34S/N76S/N88S-linker-HSA)
METPAQLLFLLLLWLPDTTGKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 33 - protein, 748 aa, Artificial Sequence
  Synthetic RSLV-316 (HSA-linker-RNase1 N34S/N76S/N88S)
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDST

SEQ ID NO: 34 - protein, 880 aa, Artificial Sequence
  Synthetic RSLV-317 (DNase1 N18S/N106S/A114F-linker-HSA)
METPAQLLFLLLLWLPDTTGLKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 35 - protein, 880 aa, Artificial Sequence
  Synthetic RSLV-318 (HSA-linker-DNase1 N18S/N106S/A114F)
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 36 - protein, 1023 aa, Artificial Sequence
  Synthetic RSLV-319 (RNase1 N34S/N76S/N88S-linker-HSA-linker-DNase1 A114F)
METPAQLLFLLLLWLPDTTGKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 37 - protein, 1023 aa, Artificial Sequence
  Synthetic RSLV-320 (DNase1 A114F-linker-HSA-linker-RNase1 N34S/N76S/N88S)
METPAQLLFLLLLWLPDTTGLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDST

SEQ ID NO: 38 - protein, 1023 aa, Artificial Sequence
  Synthetic RSLV-321 (RNase1 N34S/N76S/N88S-linker-HSA-linker-DNase1 N18S/N106S/A114F)
METPAQLLFLLLLWLPDTTGKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 39 - protein, 1023 aa, Artificial Sequence
  Synthetic RSLV-322 (DNase1 N18S/N106S/A114F-linker-HSA-linker-RNase1 N34S/N76S/N88S)
METPAQLLFLLLLWLPDTTGLKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDST

SEQ ID NO: 40 - protein, 1008 aa, Artificial Sequence
  Synthetic RSLV-323 (DNase A114F-linker-RNase-HSA)
METPAQLLFLLLLWLPDTTGLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 41 - protein, 1008 aa, Artificial Sequence
  Synthetic RSLV-324 (HSA-RNase-linker-DNase-A114F)
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 42 - protein, 713 aa, Artificial Sequence
  Synthetic RSLV-301  (HSA-RNase; w/o leader)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 43 - protein, 713 aa, Artificial Sequence
  Synthetic RSLV-302  (RNase-HSA; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 44 - protein, 728 aa, Artificial Sequence
  Synthetic RSLV-303  (HSA-linker-RNase; w/o leader)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 45 - protein, 728 aa, Artificial Sequence
  Synthetic RSLV-304  (RNase-linker-HSA; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 46 - protein, 841 aa, Artificial Sequence
  Synthetic RSLV-305  (RNase-HSA-RNase; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 47 - protein, 871 aa, Artificial Sequence
  Synthetic RSLV-306  (RNase-linker-HSA-linker-RNase; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 48 - protein, 973 aa, Artificial Sequence
  Synthetic RSLV-307  (RNase-HSA-DNase A114F; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 49 - protein, 1003 aa, Artificial Sequence
  Synthetic RSLV-308  (RNase-linker-HSA-linker-DNase A114F; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 50 - protein, 973 aa, Artificial Sequence
  Synthetic RSLV-309  (DNase A114F-HSA-RNase; w/o leader)
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 51 - protein, 1003 aa, Artificial Sequence
  Synthetic RSLV-310  (DNase1 A114F-linker-HSA-linker-RNase1; w/o leader)
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 52 - protein, 845 aa, Artificial Sequence
  Synthetic RSLV-311  (DNase A114F-HSA; w/o leader)
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 53 - protein, 845 aa, Artificial Sequence
  Synthetic RSLV-312  (HSA-DNase A114F; w/o leader)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 54 - protein, 860 aa, Artificial Sequence
  Synthetic RSLV-313  (DNase A114F-linker-HSA; w/o leader)
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 55 - protein, 860 aa, Artificial Sequence
  Synthetic RSLV-314  (HSA-linker-DNase A114F; w/o leader)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 56 - protein, 728 aa, Artificial Sequence
  Synthetic RSLV-315  (RNase I N34S/N76S/N88S-linker-HSA; w/o leader)
KESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 57 - protein, 728 aa, Artificial Sequence
  Synthetic RSLV-316  (HSA-linker-RNase1 N34S/N76S/N88S; w/o leader)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDST

SEQ ID NO: 58 - protein, 860 aa, Artificial Sequence
  Synthetic RSLV-317  (DNase1 N18S/N106S/A114F-linker-HSA; w/o leader)
LKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 59 - protein, 860 aa, Artificial Sequence
  Synthetic RSLV-318  (HSA-linker-DNase1 N18S/N106S/A114F; w/o leader)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 60 - protein, 1003 aa, Artificial Sequence
  Synthetic RSLV-319  (RNase1 N34S/N76S/N88S-linker-HSA-linker-DNase1 A114F; w/o leader)
KESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 61 - protein, 1003 aa, Artificial Sequence
  Synthetic RSLV-320  (DNase1 A114F-linker-HSA-linker-RNase1 N34S/N76S/N88S; w/o leader)
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDST

SEQ ID NO: 62 - protein, 1003 aa, Artificial Sequence
  Synthetic RSLV-321  (RNase1 N34S/N76S/N88S-linker-HSA-linker-DNase1 N18S/N106S/A114F; w/o leader)
KESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 63 - protein, 1003 aa, Artificial Sequence
  Synthetic RSLV-322  (DNase1 N18S/N106S/A114F-linker-HSA-linker-RNase1 N34S/N76S/N88S; w/o leader)
LKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDST

SEQ ID NO: 64 - protein, 988 aa, Artificial Sequence
  Synthetic RSLV-323  (DNase A114F-linker-RNase-HSA; w/o leader)
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLKGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 65 - protein, 988 aa, Artificial Sequence
  Synthetic RSLV-324  (HSA-RNase-linker-DNase-A114F; w/o leader)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 66 - protein, 260 aa, Homo sapiens
  misc_feature (1)..(260): Mature human DNase1
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 67 - protein, 282 aa, Homo sapiens [sequence omitted]

SEQ ID NO: 68 - protein, 260 aa, Artificial Sequence
  Synthetic Mature human DNase1 A114F
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 69 - protein, 260 aa, Artificial Sequence
  Synthetic Mature human DNase1 G105R
LKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCRNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 70 - protein, 285 aa, Artificial Sequence
  Synthetic Mature human DNase1L3
MRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 71 - protein, 369 aa, Homo sapiens
  misc_feature (1)..(369): Human Trex
MGPGARRQGRIVQGRPEMCFCPPPTPLPPLRILTLGTHTPTPCSSPGSAAGTYPTMGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 72 - protein, 360 aa, Homo sapiens
  misc_feature (1)..(360): Human DNase2 alpha
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 73 - protein, 361 aa, Homo sapiens
  misc_feature (1)..(361): Human DNase2 beta
MKQKMMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 74 - protein, 310 aa, Mus musculus
  misc_feature (1)..(310): Mouse DNase1L3
MSLHPASPRLASLLLFILALHDTLALRLCSFNVRSFGASKKENHEAMDIIVKIIKRCDLILLMEIKDSSNNICPMLMEKLNGNSRRSTTYNYVISSRLGRNTYKEQYAFVYKEKLVSVKTKYHYHDYQDGDTDVFSREPFVVWFHSPFTAVKDFVIVPLHTTPETSVKEIDELVDVYTDVRSQWKTENFIFMGDFNAGCSYVPKKAWQNIRLRTDPKFVWLIGDQEDTTVKKSTSCAYDRIVLCGQEIVNSVVPRSSGVFDFQKAYDLSEEEALDVSDHFPVEFKLQSSRAFTNNRKSVSLKKRKKGNRS

SEQ ID NO: 75 - protein, 128 aa, Homo sapiens
  misc_feature (1)..(128): Mature human RNase1
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 76 - protein, 156 aa, Homo sapiens
  misc_feature (1)..(156): Precursor human RNase1
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 77 - protein, 197 aa, Homo sapiens
  misc_feature (1)..(197): HSA domain I
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQR

SEQ ID NO: 78 - protein, 197 aa, Homo sapiens
  misc_feature (1)..(197): HSA domain II
GKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQ

SEQ ID NO: 79 - protein, 200 aa, Homo sapiens
  misc_feature (1)..(200): HSA domain III
NLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 80 - protein, 47 aa, Artificial Sequence
  Synthetic Linker
LEAEAAAKEAAAKEAAAKEAAAKALEAEAAAKEAAAKEAAAKEAAAK

SEQ ID NO: 81 - protein, 4 aa, Artificial Sequence
  Synthetic Linker
GGSG

SEQ ID NO: 82 - protein, 4 aa, Artificial Sequence
  Synthetic Linker
GSAT

SEQ ID NO: 83 - protein, 260 aa, Artificial Sequence
  Synthetic Mature human DNase1 N18S/N106S/A114F
LKIAAFNIQTFGETKMSSATLVSYIVQILSRYDIALVQEVRDSHLTAVGKLLDNLNQDAPDTYHYVVSEPLGRNSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPFNFQAAYGLSDQLAQAISDHYPVEVMLK

SEQ ID NO: 84 - protein, 128 aa, Artificial Sequence
  Synthetic Mature human RNase1 N34S/N76S/N88S
KESRAKKFQRQHMDSDSSPSSSSTYCNQMMRRRSMTQGRCKPVNTFVHEPLVDVQNVCFQEKVTCKNGQGNCYKSSSSMHITDCRLTSGSRYPNCAYRTSPKERHIIVACEGSPYVPVHFDASVEDST

SEQ ID NO: 85 - protein, 15 aa, Artificial Sequence
  Synthetic Linker
GGGGSGGGGSGGGGS

SEQ ID NO: 86 - protein, 20 aa, Artificial Sequence
  Synthetic VK3LP
METPAQLLFLLLLWLPDTTG

SEQ ID NO: 87 - protein, 17 aa, Gaussia princeps
  misc_feature (1)..(17): Gaussia luciferase signal peptide
MGVKVLFALICIAVAEA

SEQ ID NO: 88 - protein, 19 aa, Artificial Sequence
  Synthetic NLG linker
VDGAAASPVNVSSPSVQDI

SEQ ID NO: 89 - protein, 50 aa, Artificial Sequence
  Synthetic Linker
LEAEAAAKEAAAKEAAAKEAAAKALEAEAAAKEAAAKEAAAKEAAAKALE

SEQ ID NO: 90 - DNA, 2211 bp, Artificial Sequence
  Synthetic RSLV-301 nucleic acid
atggaaacccctgcccagctgctgttcctgctgctgctgtggctgcccgacaccaccggcgacgcccacaagtctgaggtggcccaccggttcaaggacctgggcgaggaaaacttcaaggccctggtgctgatcgccttcgcccagtacctgcagcagtgccccttcgaggaccacgtgaagctggtcaacgaagtgaccgagttcgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagtttgccgaggtgtccaagctggtcaccgacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgccttcgtcgagaagtgttgcaaggccgacgacaaagagacatgcttcgccgaagagggcaagaaactggtggccgcctctcaggccgccctgggcctgaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaagaaaaagtcacttgcaagaacggccagggcaactgctacaagagcaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattccacctgatgactcgag

SEQ ID NO: 91 - DNA, 2211 bp, Artificial Sequence
  Synthetic RSLV-302 nucleic acid
atggaaacccctgcccagctgctgttcctgctgctgctgtggctgcccgacaccaccggcaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaggaaaaagtcacttgcaagaacggccagggcaactgctacaagtccaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattccaccgacgcccacaagtccgaggtggcccaccggttcaaggacctgggcgaggaaaacttcaaggccctggtgctgatcgccttcgcccagtacctgcagcagtgccccttcgaggaccacgtgaagctggtcaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagtttgccgaggtgtccaagctggtcaccgacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgccttcgtcgagaagtgttgcaaggccgacgacaaagagacatgcttcgccgaagagggcaagaaactggtggccgcctctcaggccgccctgggcctgtgatgactcgag

SEQ ID NO: 92 - DNA, 2256 bp, Artificial Sequence
  Synthetic RSLV-303 nucleic acid
atggaaacccctgcccagctgctgttcctgctgctgctgtggctgcccgacaccaccggcgacgcccacaagtctgaggtggcccaccggttcaaggacctgggcgaggaaaacttcaaggccctggtgctgatcgccttcgcccagtacctgcagcagtgccccttcgaggaccacgtgaagctggtcaacgaagtgaccgagttcgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagtttgccgaggtgtccaagctggtcaccgacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgccttcgtcgagaagtgttgcaaggccgacgacaaagagacatgcttcgccgaagagggcaagaaactggtggccgcctctcaggccgctctgggactgggaggcggaggatctggcggaggcggttctggtggcggcggatccaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaagaaaaagtcacttgcaagaacggccagggcaactgctacaagagcaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattccacctgatgactcgag

SEQ ID NO: 93 - DNA, 2256 bp, Artificial Sequence
  Synthetic RSLV-304 nucleic acid
atggaaacccctgcccagctgctgttcctgctgctgctgtggctgcccgacaccaccggcaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaggaaaaagtcacttgcaagaacggccagggcaactgctacaagtccaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattccaccggcggaggcggatctggcggcggaggttctggtggcggcggatctgacgcccacaagtccgaggtggcccaccggttcaaggacctgggcgaggaaaacttcaaggccctggtgctgatcgccttcgcccagtacctgcagcagtgccccttcgaggaccacgtgaagctggtcaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagtttgccgaggtgtccaagctggtcaccgacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgccttcgtcgagaagtgttgcaaggccgacgacaaagagacatgcttcgccgaagagggcaagaaactggtggccgcctctcaggccgccctgggcctgtgatgactcgag

SEQ ID NO: 94 - DNA, 3081 bp, Artificial Sequence
  Synthetic RSLV-308 nucleic acid
atggaaacccctgcccagctgctgttcctgctgctgctgtggctgcccgacaccaccggcaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaagaaaaagtcacttgcaagaacggccagggcaactgctacaagtccaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattccaccggcggaggcggatctggcggcggaggttctggtggcggcggatctgacgcccacaagtccgaggtggcccaccggttcaaggacctgggcgaggaaaacttcaaggccctggtgctgatcgccttcgcccagtacctgcagcagtgccccttcgaggaccacgtgaagctggtcaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagtttgccgaggtgtccaagctggtcaccgacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgccttcgtcgagaagtgttgcaaggccgacgacaaagagacatgcttcgccgaagagggcaagaaactggtggccgcctctcaggccgctctgggactgggaggcggaggaagtggtggcggaggtagcggaggtggcggctccctgaagatcgccgcctttaacatccagaccttcggcgagacaaagatgtccaacgctaccctggtgtcctacatcgtgcagatcctgtccagatacgatatcgccctggtgcaggaagtgcgggactcccacctgaccgccgtgggcaagctgctggacaacctgaaccaggacgcccccgacacctaccactacgtggtgtccgagcctctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtccgcgagtttgccatcgtgcccctgcacgctgctccaggcgacgccgtggctgagatcgacgccctgtacgacgtgtacctggatgtgcaggaaaagtggggcctggaagatgtgatgctgatgggcgacttcaacgccggctgctcctacgtgcggccctcccagtggtcctccatccggctgtggaccagccccaccttccagtggctgatccccgactccgccgataccaccgccacccctacccactgtgcctacgaccggatcgtggtggccggcatgctgctgaggggtgccgtggtgcctgactccgccctgccattcaattttcaagccgcctacggcctgtccgaccagctggcccaggccatctccgaccactaccccgtggaagtgatgctgaagtgatgactcgag

SEQ ID NO: 95 - DNA, 3081 bp, Artificial Sequence
  Synthetic RSLV-310 nucleic acid
atggaaacccctgcccagctgctgttcctgctgctgctgtggctgcccgacaccaccggcctgaagatcgccgccttcaacatccagaccttcggcgagacaaagatgtccaacgccaccctggtgtcctacatcgtgcagatcctgtccagatacgatatcgccctggtgcaggaagtgcgggactcccacctgaccgccgtgggcaagctgctggacaacctgaaccaggacgcccccgacacctaccactacgtggtgtccgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtccgcgagttcgccatcgtgcccctgcatgctgctccaggcgacgccgtggccgagatcgacgccctgtacgacgtgtacctggacgtgcaggaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccacccctacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggggggaggcggatctggcggcggaggttctggtggcggcggatctgacgcccacaagtccgaggtggcccaccggttcaaggacctgggcgaggaaaacttcaaggccctggtgctgatcgccttcgcccagtacctgcagcagtgccccttcgaggaccacgtgaagctggtcaacgaagtgaccgagtttgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagttcgccgaggtgtccaagctggtcaccgacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccaccccaaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggccgctctgggactgggaggcggaggaagtggtggcggaggtagtggcggaggcggctccaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagccactggtggatgtgcagaacgtgtgttttcaagaaaaagtcacttgcaagaacggccagggcaactgctacaagagcaactcctccatgcacatcaccgactgccggctgaccaacggctccagataccccaactgtgcctaccggacctcccctaaagaacggcacatcatcgtggcctgcgagggctccccttacgtgcccgtgcacttcgacgcctccgtggaagattccacctgatgactcgag

SEQ ID NO: 96 - DNA, 2607 bp, Artificial Sequence
  Synthetic RSLV-311 nucleic acid
atggaaacccctgcccagctgctgttcctgctgctgctgtggctgcccgacaccaccggcctgaagatcgccgccttcaacatccagaccttcggcgagacaaagatgtccaacgccaccctggtgtcctacatcgtgcagatcctgtccagatacgatatcgccctggtgcaggaagtgcgggactcccacctgaccgccgtgggcaagctgctggacaacctgaaccaggacgcccccgacacctaccactacgtggtgtccgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtccgcgagttcgccatcgtgcccctgcatgctgctccaggcgacgccgtggccgagatcgacgccctgtacgacgtgtacctggacgtgcaggaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccacccctacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggacgcccacaagtccgaggtggcccaccggttcaaggacctgggcgaggaaaacttcaaggccctggtgctgatcgccttcgcccagtacctgcagcagtgccccttcgaggaccacgtgaagctggtcaacgaagtgaccgagtttgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagttcgccgaggtgtccaagctggtcaccgacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccaccccaaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggccgccctgggcctgtgatgactcgag

SEQ ID NO: 97 - DNA, 2607 bp, Artificial Sequence
  Synthetic RSLV-312 nucleic acid
atggaaacccctgcccagctgctgttcctgctgctgctgtggctgcccgacaccaccggcgacgcccacaagtctgaggtggcccaccggttcaaggacctgggcgaggaaaacttcaaggccctggtgctgatcgccttcgcccagtacctgcagcagtgccccttcgaggaccacgtgaagctggtcaacgaagtgaccgagttcgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagtttgccgaggtgtccaagctggtcaccgacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgccttcgtcgagaagtgttgcaaggccgacgacaaagagacatgcttcgccgaagagggcaagaaactggtggccgcctctcaggccgctctgggcctgctgaagatcgccgcctttaacatccagaccttcggcgagacaaagatgtccaacgctaccctggtgtcctacatcgtgcagatcctgtccagatacgatatcgccctggtgcaggaagtgcgggactcccacctgaccgccgtgggcaagctgctggacaacctgaaccaggacgcccccgacacctaccactacgtggtgtccgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtccgcgagtttgccatcgtgcccctgcacgctgctccaggcgacgccgtggctgagatcgacgccctgtacgacgtgtacctggacgtgcaggaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccacccctacccactgcgcctacgacaggatcgtggtggccggcatgctgctgaggggcgctgtggtgcctgactccgccctgccattcaattttcaagccgcctacggcctgtccgaccagctggcccaggccatctccgaccactaccccgtggaagtgatgctgaagtgatgactcgag

SEQ ID NO: 98 - DNA, 2652 bp, Artificial Sequence
  Synthetic RSLV-313 nucleic acid
atggaaacccctgcccagctgctgttcctgctgctgctgtggctgcccgacaccaccggcctgaagatcgccgccttcaacatccagaccttcggcgagacaaagatgtccaacgccaccctggtgtcctacatcgtgcagatcctgtccagatacgatatcgccctggtgcaggaagtgcgggactcccacctgaccgccgtgggcaagctgctggacaacctgaaccaggacgcccccgacacctaccactacgtggtgtccgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtccgcgagttcgccatcgtgcccctgcatgctgctccaggcgacgccgtggccgagatcgacgccctgtacgacgtgtacctggacgtgcaggaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccacccctacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggggggaggcggatctggcggcggaggttctggtggcggcggatctgacgcccacaagtccgaggtggcccaccggttcaaggacctgggcgaggaaaacttcaaggccctggtgctgatcgccttcgcccagtacctgcagcagtgccccttcgaggaccacgtgaagctggtcaacgaagtgaccgagtttgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagttcgccgaggtgtccaagctggtcaccgacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccaccccaaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggccgccctgggcctgtgatgactcgag

SEQ ID NO: 99 - DNA, 2652 bp, Artificial Sequence
  Synthetic RSLV-314 nucleic acid
atggaaacccctgcccagctgctgttcctgctgctgctgtggctgcccgacaccaccggcgacgcccacaagtctgaggtggcccaccggttcaaggacctgggcgaggaaaacttcaaggccctggtgctgatcgccttcgcccagtacctgcagcagtgccccttcgaggaccacgtgaagctggtcaacgaagtgaccgagttcgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacctgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgcgggacgagggcaaggcctcctccgccaagcagagactgaagtgcgcctccctgcagaagttcggcgagcgggcctttaaggcctgggccgtggcccggctgtctcagagattccccaaggccgagtttgccgaggtgtccaagctggtcaccgacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtcaacagacggccctgcttctccgccctggaagtggacgagacatacgtgcccaaagagttcaacgccgagacattcaccttccacgccgacatctgcaccctgtccgagaaagagcggcagatcaagaaacagaccgccctggtcgagctggtcaagcacaagcccaaggccaccaaagaacagctgaaggccgtgatggacgacttcgccgccttcgtcgagaagtgttgcaaggccgacgacaaagagacatgcttcgccgaagagggcaagaaactggtggccgcctctcaggccgctctgggactgggaggcggaggatctggcggaggcggttctggtggtggcggctccctgaagatcgccgcctttaacatccagaccttcggcgagacaaagatgtccaacgctaccctggtgtcctacatcgtgcagatcctgtccagatacgatatcgccctggtgcaggaagtgcgggactcccacctgaccgccgtgggcaagctgctggacaacctgaaccaggacgcccccgacacctaccactacgtggtgtccgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtccgcgagtttgccatcgtgcccctgcacgctgctccaggcgacgccgtggctgagatcgacgccctgtacgacgtgtacctggacgtgcaggaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccacccctacccactgcgcctacgacaggatcgtggtggccggcatgctgctgaggggcgctgtggtgcctgactccgccctgccattcaattttcaagccgcctacggcctgtccgaccagctggcccaggccatctccgaccactaccccgtggaagtgatgctgaagtgatgactcgag

SEQ ID NO: 100 - protein, 609 aa, Homo sapiens [sequence omitted]

SEQ ID NO: 101 - protein, 7 aa, Artificial Sequence
  Synthetic O-linked glycosylation consensus
  misc_feature (2)..(3): Xaa can be any naturally occurring amino acid
  misc_feature (6)..(6): Xaa is Thr or Ser
CXXGGXC

SEQ ID NO: 102 - protein, 5 aa, Artificial Sequence
  Synthetic O-linked glycosylation consensus
  misc_feature (4)..(4): Xaa is Glu or Asp
NSTXA

SEQ ID NO: 103 - protein, 5 aa, Artificial Sequence
  Synthetic O-linked glycosylation consensus
NITQS

SEQ ID NO: 104 - protein, 5 aa, Artificial Sequence
  Synthetic O-linked glycosylation consensus
QSTQS

SEQ ID NO: 105 - protein, 5 aa, Artificial Sequence
  Synthetic O-linked glycosylation consensus
  misc_feature (1)..(1): Xaa is Asp or Glu
  misc_feature (4)..(4): Xaa is Arg or Lys
XFTXV

SEQ ID NO: 106 - protein, 4 aa, Artificial Sequence
  Synthetic O-linked glycosylation consensus
  misc_feature (2)..(2): Xaa is Glu or Asp
CXSN

SEQ ID NO: 107 - protein, 5 aa, Artificial Sequence
  Synthetic O-linked glycosylation consensus
  misc_feature (5)..(5): Xaa is Lys or Arg
GGSCX

SEQ ID NO: 108 - protein, 260 aa, Artificial Sequence
  Synthetic Mature human DNase1 E13R/N74K/A114F/ T205K
LKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 109 - protein, 260 aa, Artificial Sequence
  Synthetic Mature human DNase1 E13R/N74K/A114F/ T205K/N18S/N106S
LKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 110 - protein, 880 aa, Artificial Sequence
  Synthetic RSLV-325 (HSA-linker-DNase E13R/N74K/A114F/ T205K)
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 111 - protein, 880 aa, Artificial Sequence
  Synthetic RSLV-326 (DNase E13R/N74K/A114F/ T205K-linker-HSA)
METPAQLLFLLLLWLPDTTGLKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 112 - protein, 1023 aa, Artificial Sequence
  Synthetic RSLV-327 (RNase-linker-HSA-linker-DNase E13R/N74K/A114F/ T205K)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 113 - protein, 1023 aa, Artificial Sequence
  Synthetic RSLV-328 (DNase E13R/N74K/A114F/ T205K-linker-HSA-linker-RNase)
METPAQLLFLLLLWLPDTTGLKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 114 - protein, 1026 aa, Artificial Sequence
  Synthetic RSLV-329 (RNase-linker-HSA-linker-DNase E13R/N74K/A114F/ T205K)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVDGASSPVNVSSPSVQDILKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 115 - protein, 880 aa, Artificial Sequence
  Synthetic RSLV-330 (DNase E13R/N74K/A114F/ T205K/N18S/N106S-linker-HSA)
METPAQLLFLLLLWLPDTTGLKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 116 - protein, 1023 aa, Artificial Sequence
  Synthetic RSLV-331 (RNase-linker-HSA-linker-DNase E13R/N74K/A114F/ T205K/N18S/N106S)
METPAQLLFLLLLWLPDTTGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 117 - protein, 1023 aa, Artificial Sequence
  Synthetic RSLV-332 (DNase E13R/N74K/A114F/ T205K/N18S/N106S-linker-HSA-linker-RNase)
METPAQLLFLLLLWLPDTTGLKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 118 - protein, 860 aa, Artificial Sequence
  Synthetic RSLV-325  (HSA-linker-DNase E13R/N74K/A114F/ T205K; w/o leader)
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 119 - protein, 860 aa, Artificial Sequence
  Synthetic RSLV-326  (DNase E13R/N74K/A114F/ T205K-linker-HSA; w/o leader)
LKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 120 - protein, 1003 aa, Artificial Sequence
  Synthetic RSLV-327  (RNase-linker-HSA-linker-DNase E13R/N74K/A114F/ T205K; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 121 - protein, 1003 aa, Artificial Sequence
  Synthetic RSLV-328  (DNase E13R/N74K/A114F/ T205K-linker-HSA-linker-RNase; w/o leader)
LKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 122 - protein, 1006 aa, Artificial Sequence
  Synthetic RSLV-329 (RNase-linker-HSA-linker-DNase E13R/N74K/A114F/ T205K; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLVDGASSPVNVSSPSVQDILKIAAFNIQTFGRTKMSNATLVSYIVQILSRYDIALVQEVRDSHLTAVGKLLDNLNQDAPDTYHYVVSEPLGRKSYKERYLFVYRPDQVSAVDSYYYDDGCEPCGNDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 123 - protein, 860 aa, Artificial Sequence
  Synthetic RSLV-330  (DNase E13R/N74K/A114F/ T205K/N18S/N106S-linker-HSA; w/o leader)
LKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 124 - protein, 1003 aa, Artificial Sequence
  Synthetic RSLV-331  (RNase-linker-HSA-linker-DNase E13R/N74K/A114F/ T205K/N18S/N106S; w/o leader)
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 125 - protein, 1003 aa, Artificial Sequence
  Synthetic RSLV-332  (DNase E13R/N74K/A114F/ T205K/N18S/N106S-linker-HSA-linker-RNase; w/o leader)
LKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLKGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 126 - DNA, 2640 bp, Artificial Sequence
  Synthetic RSLV-325 nucleic acid
atggaaacccctgcccagctgctgttcctgctgctgctgtggctgcccgacaccaccggcgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggctcggctgtcccagagattccccaaggccgagtttgccgaggtgtccaagctggtgacagacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcttctcaggctgctctgggcctgggaggcggaggatctgggggaggcggaagcggagggggcggatctctgaagatcgccgccttcaacatccagaccttcggccggaccaagatgtccaacgctaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagtttgccatcgtgcccctgcacgctgctccaggcgacgccgtggctgagatcgacgccctgtacgacgtgtacctggatgtgcaagaaaagtggggcctggaagatgtgatgctgatgggcgacttcaacgccggctgctcctacgtgcggccctcccagtggtcctccatccggctgtggaccagccccaccttccagtggctgatccccgactccgccgataccaccgccaagcccacccactgtgcctacgacagaatcgtggtggccggcatgctgctgaggggcgctgtggtgcctgactccgccctgccattcaattttcaagccgcctacggcctgtccgaccagctggcccaggccatctccgaccactaccccgtggaagtgatgctgaag

SEQ ID NO: 127 - DNA, 2640 bp, Artificial Sequence
  Synthetic RSLV-326 nucleic acid
atggaaacccctgcccagctgctgttcctgctgctgctgtggctgcccgacaccaccggcctgaagatcgccgccttcaacatccagaccttcggccggaccaagatgtccaacgccaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagttcgccatcgtgcccctgcatgctgctccaggcgacgccgtggccgagatcgacgccctgtacgacgtgtacctggacgtgcaagaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccaagcccacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggggggaggcggatctggcggagggggaagtggcggcggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagtttgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggcccggctgtcccagagattccctaaggccgagttcgccgaggtgtccaagctggtgacagacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccctaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggctgctctgggcctg

SEQ ID NO: 128 - DNA, 3069 bp, Artificial Sequence
  Synthetic RSLV-327 nucleic acid
atggaaacccctgcccagctgctgttcctgctgctgctgtggctgcccgacaccaccggcaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaagaaaaagtcacatgcaagaacggccagggcaactgctacaagtccaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattctaccggcggaggcggatctggcggcggaggaagtggcgggggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggctcggctgtcccagagattccccaaggccgagtttgccgaggtgtccaagctggtgacagacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcttctcaggctgctctgggcctgggaggcggaggatctgggggaggcggaagcggagggggcggatctctgaagatcgccgccttcaacatccagaccttcggccggaccaagatgtccaacgctaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagtttgccatcgtgcccctgcacgctgctccaggcgacgccgtggctgagatcgacgccctgtacgacgtgtacctggatgtgcaagaaaagtggggcctggaagatgtgatgctgatgggcgacttcaacgccggctgctcctacgtgcggccctcccagtggtcctccatccggctgtggaccagccccaccttccagtggctgatccccgactccgccgataccaccgccaagcccacccactgtgcctacgacagaatcgtggtggccggcatgctgctgaggggcgctgtggtgcctgactccgccctgccattcaattttcaagccgcctacggcctgtccgaccagctggcccaggccatctccgaccactaccccgtggaagtgatgctgaag

SEQ ID NO: 129 - DNA, 3069 bp, Artificial Sequence
  Synthetic RSLV-328 nucleic acid
atggaaacccctgcccagctgctgttcctgctgctgctgtggctgcccgacaccaccggcctgaagatcgccgccttcaacatccagaccttcggccggaccaagatgtccaacgccaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagttcgccatcgtgcccctgcatgctgctccaggcgacgccgtggccgagatcgacgccctgtacgacgtgtacctggacgtgcaagaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccaagcccacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggggggaggcggatctggcggagggggaagtggcggcggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagtttgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggcccggctgtcccagagattccctaaggccgagttcgccgaggtgtccaagctggtgacagacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccctaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggctgctctgggcctgggaggcggaggatctggcggaggcggctctggcgggggaggcagcaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggatgtgcagaacgtgtgttttcaagaaaaagtcacatgcaagaacggccagggcaactgctacaagagcaactcctccatgcacatcaccgactgccggctgaccaacggctccagataccccaactgtgcctaccggacctcccctaaagaacggcacatcatcgtggcctgcgagggctccccttacgtgcccgtgcacttcgacgcctccgtggaagattccacc

SEQ ID NO: 130 - DNA, 3087 bp, Artificial Sequence
  Synthetic RSLV-329 nucleic acid
atggaaacccctgcccagctgctgttcctgctgctgctgtggctgcccgacaccaccggcaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaagaaaaagtcacctgcaagaacggccagggcaactgctacaagtccaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattctaccggcggaggcggatctggaggcggaggaagtggcgggggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaggaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggctcggctgtcccagagattccccaaggccgagtttgccgaggtgtccaagctggtgacagacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggccgccctgggactggtggatggcgcctcctctcccgtgaacgtgtccagcccttccgtgcaggacatcctgaagatcgccgccttcaacatccagaccttcggccggaccaagatgtccaacgctaccctggtgtcctacatcgtgcagatcctgtccagatacgatatcgccctggtgcaggaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagtttgccatcgtgcccctgcacgctgctccaggcgacgccgtggctgagatcgacgccctgtacgacgtgtacctggatgtgcaggaaaagtggggcctggaagatgtgatgctgatgggcgacttcaacgccggctgctcctacgtgcggccctcccagtggtcctccatccggctgtggaccagccccaccttccagtggctgatccccgactccgccgataccaccgccaagcccacccactgtgcctacgacagaatcgtggtggccggcatgctgctgaggggcgctgtggtgcctgactccgccctgccattcaattttcaagccgcctacggcctgtccgaccagctggcccaggccatctccgaccactaccccgtggaagtgatgctgaagtgactcgag

SEQ ID NO: 131 - DNA, 2640 bp, Artificial Sequence
  Synthetic RSLV-330 nucleic acid
atggaaacccctgcccagctgctgttcctgctgctgctgtggctgcccgacaccaccggcctgaagatcgccgccttcaacatccagaccttcggccggaccaagatgtccagcgccaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcagcgacaccttcaaccgcgagcccttcatcgtgcggttcttcagccggttcaccgaagtgcgcgagttcgccatcgtgcccctgcatgctgctccaggcgacgccgtggccgagatcgacgccctgtacgacgtgtacctggacgtgcaagaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccaagcccacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggggggaggcggatctggcggagggggaagtggcggcggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagtttgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggcccggctgtcccagagattccctaaggccgagttcgccgaggtgtccaagctggtgacagacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccctaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggctgctctgggcctg

SEQ ID NO: 132 - DNA, 3069 bp, Artificial Sequence
  Synthetic RSLV-331 nucleic acid
atggaaacccctgcccagctgctgttcctgctgctgctgtggctgcccgacaccaccggcaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaagaaaaagtcacatgcaagaacggccagggcaactgctacaagtccaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattctaccggcggaggcggatctggcggcggaggaagtggcgggggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggctcggctgtcccagagattccccaaggccgagtttgccgaggtgtccaagctggtgacagacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcttctcaggctgctctgggcctgggaggcggaggatctgggggaggcggaagcggagggggcggatctctgaagatcgccgccttcaacatccagaccttcggccggaccaagatgtccagcgctaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcagcgacaccttcaaccgcgagcccttcatcgtgcggttcttcagccggttcaccgaagtgcgcgagtttgccatcgtgcccctgcacgctgctccaggcgacgccgtggctgagatcgacgccctgtacgacgtgtacctggatgtgcaagaaaagtggggcctggaagatgtgatgctgatgggcgacttcaacgccggctgctcctacgtgcggccctcccagtggtcctccatccggctgtggaccagccccaccttccagtggctgatccccgactccgccgataccaccgccaagcccacccactgtgcctacgacagaatcgtggtggccggcatgctgctgaggggcgctgtggtgcctgactccgccctgccattcaattttcaagccgcctacggcctgtccgaccagctggcccaggccatctccgaccactaccccgtggaagtgatgctgaag

SEQ ID NO: 133 - DNA, 3069 bp, Artificial Sequence
  Synthetic RSLV-332 nucleic acid
atggaaacccctgcccagctgctgttcctgctgctgctgtggctgcccgacaccaccggcctgaagatcgccgccttcaacatccagaccttcggccggaccaagatgtccagcgccaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcagcgacaccttcaaccgcgagcccttcatcgtgcggttcttcagccggttcaccgaagtgcgcgagttcgccatcgtgcccctgcatgctgctccaggcgacgccgtggccgagatcgacgccctgtacgacgtgtacctggacgtgcaagaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccaagcccacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggggggaggcggatctggcggagggggaagtggcggcggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagtttgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggcccggctgtcccagagattccctaaggccgagttcgccgaggtgtccaagctggtgacagacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccctaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggctgctctgggcctgggaggcggaggatctggcggaggcggctctggcgggggaggcagcaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggatgtgcagaacgtgtgttttcaagaaaaagtcacatgcaagaacggccagggcaactgctacaagagcaactcctccatgcacatcaccgactgccggctgaccaacggctccagataccccaactgtgcctaccggacctcccctaaagaacggcacatcatcgtggcctgcgagggctccccttacgtgcccgtgcacttcgacgcctccgtggaagattccacc

SEQ ID NO: 134 - DNA, 3078 bp, Artificial Sequence
  Synthetic RSLV-319 nucleic acid
atggaaacccctgcccagctgctgttcctgctgctgctgtggctgcccgacaccaccggcaaagagtcccgggccaagaagttccagcggcagcacatggactccgactccagcccctccagctcctccacctactgcaaccagatgatgcggcggagatccatgacccagggccggtgcaagcccgtgaacaccttcgtgcacgagcccctggtggacgtgcagaacgtgtgttttcaagaaaaagtgacctgcaagaacggccagggcaactgctacaagtcctcctcctccatgcacatcaccgactgccggctgacctccggctccagataccccaactgcgcctaccggacctcccccaaagaacggcacatcatcgtggcctgcgagggctccccttacgtgcccgtgcacttcgacgcctccgtggaagattctaccggcggaggcggatctggcggcggaggaagtggcgggggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggctcggctgtcccagagattccccaaggccgagtttgccgaggtgtccaagctggtgacagacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcttctcaggctgctctgggcctgggaggcggaggatctgggggaggcggaagcggagggggcggatctctgaagatcgccgccttcaacatccagaccttcggcgagacaaagatgtccaacgctaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagtttgccatcgtgcccctgcacgctgctccaggcgacgccgtggctgagatcgacgccctgtacgacgtgtacctggatgtgcaagaaaagtggggcctggaagatgtgatgctgatgggcgacttcaacgccggctgctcctacgtgcggccctcccagtggtcctccatccggctgtggaccagccccaccttccagtggctgatccccgactccgccgataccaccgccacccctacccactgtgcctacgacagaatcgtggtggccggcatgctgctgaggggcgctgtggtgcctgactccgccctgccattcaattttcaagccgcctacggcctgtccgaccagctggcccaggccatctccgaccactaccccgtggaagtgatgctgaagtgactcgag

SEQ ID NO: 135 - DNA, 3078 bp, Artificial Sequence
  Synthetic RSLV-320 nucleic acid
atggaaacccctgcccagctgctgttcctgctgctgctgtggctgcccgacaccaccggcctgaagatcgccgccttcaacatccagaccttcggcgagacaaagatgtccaacgccaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagttcgccatcgtgcccctgcatgctgctccaggcgacgccgtggccgagatcgacgccctgtacgacgtgtacctggacgtgcaagaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccacccctacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggggggaggcggatctggcggagggggaagtggcggcggaggctctgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagtttgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggctcggctgtcccagagattccctaaggccgagttcgccgaggtgtccaagctggtgacagacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccaccccaaccctggtggaagtgtcccggaatctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggctgctctgggcctgggaggcggaggatctggcggaggcggctctggcgggggaggcagcaaagagtcccgggccaagaagttccagcggcagcacatggactccgactccagcccctccagctcctccacctactgcaaccagatgatgcggcggagatccatgacccagggccggtgcaagcccgtgaacaccttcgtgcacgagcccctggtggatgtgcagaacgtgtgttttcaagaaaaagtcacatgcaagaacggccagggcaactgctacaagtctagctcctccatgcacatcaccgactgccggctgacctccggctccagataccccaactgtgcctaccggacctcccctaaagaacggcacatcatcgtggcctgcgagggctccccttacgtgcccgtgcacttcgacgcctccgtggaagattccacctgactcgag

SEQ ID NO: 136 - DNA, 3033 bp, Artificial Sequence
  Synthetic RSLV-323 nucleic acid
atggaaacccctgcccagctgctgttcctgctgctgctgtggctgcccgacaccaccggcctgaagatcgccgccttcaacatccagaccttcggcgagacaaagatgtccaacgccaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagttcgccatcgtgcccctgcatgctgctccaggcgacgccgtggccgagatcgacgccctgtacgacgtgtacctggacgtgcaagaaaagtggggcctggaagatgtgatgctgatgggcgacttcaacgccggctgctcctacgtgcggccctcccagtggtcctccatccggctgtggacctcccccaccttccagtggctgatccccgactccgccgataccaccgccacccctacccactgcgcctacgacagaatcgtggtggccggcatgctgctgagaggcgccgtggtgcctgactccgccctgccattcaattttcaagccgcctacggcctgtccgaccagctggcccaggccatctccgaccactaccccgtggaagtgatgctgaaggggggaggcggatctggcggagggggaagtggcggcggaggctccaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggatgtgcagaacgtgtgttttcaagaaaaagtcacatgcaagaacggccagggcaactgctacaagtccaactcctccatgcacatcaccgactgccggctgaccaacggctccagataccccaactgtgcctaccggacctcccctaaagaacggcacatcatcgtggcctgcgagggctccccttacgtgcccgtgcacttcgacgcctccgtggaagattccaccgacgcccacaagtccgaggtggcccaccggttcaaggacctgggcgaggaaaacttcaaggccctggtgctgatcgccttcgcccagtacctgcagcagtgccccttcgaggaccacgtgaagctggtgaacgaagtgaccgagtttgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggcccggctgtcccagagattccctaaggccgagttcgccgaggtgtccaagctggtgacagacctgaccaaggtgcacaccgagtgttgtcacggcgacctgctggaatgcgccgacgacagggccgacctggccaagtacatctgcgagaaccaggactccatctcctccaagctgaaagagtgctgcgagaagcccctgctggaaaagtcccactgtatcgctgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccaccccaaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggccgccctgggcctgtgactcgag

SEQ ID NO: 137 - DNA, 3033 bp, Artificial Sequence
  Synthetic RSLV-324 nucleic acid
atggaaacccctgcccagctgctgttcctgctgctgctgtggctgcccgataccaccggcgacgcccacaagtccgaggtggcccacagattcaaggacctgggcgaggaaaacttcaaggccctggtgctgatcgccttcgcccagtacctgcagcagtgccccttcgaggaccacgtgaagctggtgaacgaagtgaccgagttcgccaagacctgcgtggccgacgagtccgccgagaactgcgacaagtccctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggctcggctgtcccagagattccccaaggccgagtttgccgaggtgtccaagctggtgacagacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcctctcaggccgccctgggcctgaaagagtcccgggccaagaagttccagcggcagcacatggactccgactccagcccctccagctcctccacctactgcaaccagatgatgcggcggagaaacatgacccagggccggtgcaagcccgtgaacaccttcgtgcacgagcccctggtggacgtgcagaacgtgtgttttcaagaaaaagtcacatgcaagaacggccagggcaactgctacaagagcaactcctccatgcacatcaccgactgccggctgaccaacggctccagataccccaactgcgcctaccggacctcccccaaagaacggcacatcatcgtggcctgcgagggctccccttacgtgcccgtgcacttcgacgcctccgtggaagattctacaggcggaggcggatctggcggcggaggaagtggcgggggaggctctctgaagatcgccgccttcaacatccagaccttcggcgagacaaagatgtccaacgctaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaactcctacaaagaaagatacctgttcgtgtaccggcccgaccaggtgtccgccgtggactcctactactacgacgacggctgcgagccctgcggcaacgacaccttcaaccgcgagcccttcatcgtgcggttcttcagccggttcaccgaagtgcgcgagtttgccatcgtgcccctgcacgctgctccaggcgacgccgtggctgagatcgacgccctgtacgacgtgtacctggatgtgcaagaaaagtggggcctggaagatgtgatgctgatgggcgacttcaacgccggctgctcctacgtgcggccctcccagtggtcctccatccggctgtggaccagccccaccttccagtggctgatccccgactctgccgacaccaccgccacccctacccactgtgcctacgacagaatcgtggtggccggcatgctgctgaggggcgctgtggtgcctgactccgccctgccattcaattttcaagccgcctacggcctgtccgaccagctggcccaggccatctccgaccactaccccgtggaagtgatgctgaagtgactcgag

SEQ ID NO: 138 - protein, 880 aa, Artificial Sequence
  Synthetic HSA-linker-DNase E13R/N74K/A114F/ T205K/N18S/N106S
METPAQLLFLLLLWLPDTTGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 139 - protein, 860 aa, Artificial Sequence
  Synthetic HSA-linker-DNase E13R/N74K/A114F/ T205K/N18S/N106S; w/o leader
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSLKIAAFNIQTFGRTKMSSATLVSYIVQILSRYDIALVQEVRDSHLTAVGKLLDNLNQDAPDTYHYVVSEPLGRKSYKERYLFVYRPDQVSAVDSYYYDDGCEPCGSDTFNREPFIVRFFSRFTEVREFAIVPLHAAPGDAVAEIDALYDVYLDVQEKWGLEDVMLMGDFNAGCSYVRPSQWSSIRLWTSPTFQWLIPDSADTTAKPTHCAYDRIVVAGMLLRGAVVPDSALPFNFQAAYGLSDQLAQAISDHYPVEVMLK

SEQ ID NO: 140 - DNA, 2640 bp, Artificial Sequence
  Synthetic HSA-linker-DNase E13R/N74K/A114F/ T205K/N18S/N106S nucleic acid
atggaaacccctgcccagctgctgttcctgctgctgctgtggctgcccgacaccaccggcgatgcccacaagtctgaggtggcccaccggttcaaggacctgggcgaggaaaacttcaaggccctggtgctgatcgccttcgcccagtacctgcagcagtgccccttcgaggaccacgtgaagctggtgaacgaagtgaccgagttcgccaagacctgcgtggccgacgagtccgccgagaactgcgacaagagcctgcacaccctgttcggcgacaagctgtgcaccgtggccaccctgcgggaaacctacggcgagatggccgactgctgcgccaagcaagaacccgagcggaacgagtgcttcctgcagcacaaggacgacaaccccaacctgccccggctggtccgacccgaggtggacgtgatgtgcaccgccttccacgacaacgaggaaaccttcctgaagaagtacctgtacgagatcgccagacggcacccctacttctacgcccccgagctgctgtttttcgccaagcggtacaaggccgccttcaccgagtgctgccaggccgccgataaggccgcctgcctgctgcctaagctggacgagctgagggacgagggcaaggcctcctctgccaagcagcggctgaagtgcgcctccctgcagaagttcggcgagcgggcctttaaggcctgggccgtggctcggctgtcccagagattccccaaggccgagtttgccgaggtgtccaagctggtgacagacctgaccaaggtgcacaccgagtgttgtcacggcgacctgctggaatgcgccgacgacagagccgacctggccaagtacatctgcgagaaccaggactccatctcctccaagctgaaagagtgctgcgagaagcccctgctggaaaagtcccactgtatcgccgaggtggaaaacgacgagatgcccgccgacctgccttccctggccgccgacttcgtggaatccaaggacgtgtgcaagaactacgccgaggccaaggatgtgttcctgggcatgttcctgtacgagtacgctcggcggcaccccgactactccgtggtgctgctgctgagactggccaagacctacgagacaaccctggaaaagtgctgcgccgctgccgacccccacgagtgctacgccaaggtgttcgacgagttcaagcctctggtggaagaaccccagaacctgatcaagcagaactgcgagctgttcgagcagctgggcgagtacaagttccagaacgccctgctggtccgatacaccaagaaagtgccccaggtgtccacccccaccctggtggaagtgtcccggaacctgggcaaagtgggctccaagtgctgcaagcaccctgaggccaagcggatgccctgcgccgaggactacctgagcgtggtgctgaaccagctgtgcgtgctgcacgaaaagacccccgtgtccgacagagtgaccaagtgctgtaccgagtccctggtgaacagacggccctgcttctccgccctggaagtggacgagacatacgtgcccaaagagttcaacgccgagacattcaccttccacgccgacatctgcaccctgtccgagaaagagcggcagatcaagaaacagaccgcactggtggaactggtgaaacacaagcccaaggccaccaaagaacagctgaaggccgtgatggacgacttcgccgcctttgtggaaaagtgttgcaaggccgacgacaaagagacatgcttcgccgaagagggcaagaaactggtggccgcttctcaggctgctctgggcctgggaggcggaggatctgggggaggcggaagcggagggggcggatctctgaagatcgccgccttcaacatccagaccttcggccggaccaagatgtccagcgctaccctggtgtcctacatcgtgcagatcctgtccagatacgatatcgccctggtgcaagaagtgcgggactcccacctgaccgccgtgggcaagctgctggacaacctgaaccaggacgcccccgacacctaccactacgtggtgtctgagcccctgggccggaagtcctacaaagaaagatacctgttcgtgtaccggcccgaccaggtgtccgccgtggactcctactactacgacgacggctgcgagccctgcggcagcgacaccttcaaccgcgagcccttcatcgtgcggttcttcagccggttcaccgaagtgcgcgagtttgccatcgtgcccctgcacgctgctccaggcgacgccgtggctgagatcgacgccctgtacgacgtgtacctggatgtgcaagaaaagtggggcctggaagatgtgatgctgatgggcgacttcaacgccggctgctcctacgtgcggccctcccagtggtcctccatccggctgtggaccagccccaccttccagtggctgatccccgactccgccgataccaccgccaagcccacccactgtgcctacgacagaatcgtggtggccggcatgctgctgaggggcgctgtggtgcctgactccgccctgccattcaattttcaagccgcctacggcctgtccgaccagctggcccaggccatctccgaccactaccccgtggaagtgatgctgaag

SEQ ID NO: 141 - protein, 25 aa, Artificial Sequence
  Synthetic Linker
  misc_feature (6)..(25): "Xaa Xaa Xaa Xaa Xaa", if present, is "Gly Gly Gly Gly Ser" and may repeat up to 4 times
GGGGSXXXXXXXXXXXXXXXXXXXX

SEQ ID NO: 142 - protein, 5 aa, Artificial Sequence
  Synthetic Linker
GGGGS

SEQ ID NO: 143 - protein, 10 aa, Artificial Sequence
  Synthetic Linker
GGGGSGGGGS

SEQ ID NO: 144 - protein, 20 aa, Artificial Sequence
  Synthetic Linker
GGGGSGGGGSGGGGSGGGGS

SEQ ID NO: 145 - protein, 25 aa, Artificial Sequence
  Synthetic Linker
GGGGSGGGGSGGGGSGGGGSGGGGS

SEQ ID NO: 146 - protein, 27 aa, Artificial Sequence
  Synthetic Linker
  misc_feature (12)..(26): "Xaa Xaa Xaa Xaa Xaa", if present, is "Glu Ala Ala Ala Lys" and may repeat up to 3 times
AEAAAKEAAAKXXXXXXXXXXXXXXXA

SEQ ID NO: 147 - protein, 20 aa, Artificial Sequence
  Synthetic Linker
  misc_feature (5)..(20): "Xaa Xaa Xaa Xaa", if present, is "Gly Gly Ser Gly" and may repeat up to 4 times
GGSGXXXXXXXXXXXXXXXX

SEQ ID NO: 148 - protein, 30 aa, Artificial Sequence
  Synthetic Linker
  misc_feature (7)..(30): "Xaa Xaa Xaa Xaa Xaa Xaa", if present, is "Gly Gly Ser Gly Gly Ser" and may repeat up to 4 times
GGSGGSXXXXXXXXXXXXXXXXXXXXXXXX

SEQ ID NO: 149 - protein, 18 aa, Artificial Sequence
  Synthetic Linker
VDGASSPVNVSSPSVQDI

We claim:

1. A fusion protein comprising:
a mutant human DNase comprising one or more mutations selected from the group consisting of E13R, N74K, A114F and T205K, wherein the mutation numbering corresponds to SEQ ID NO: 66, operably coupled, with or without a linker, to
a human serum albumin or a human serum albumin variant, wherein the human serum albumin variant has greater than 90% sequence identity to the amino acid sequence of human serum albumin set forth in SEQ ID NO: 1, and wherein the human serum albumin or human serum albumin variant is operably coupled, with or without a linker, to
a human RNase; and
wherein the fusion protein has increased serum half-life relative to a fusion protein comprising the human mutant DNase and the human RNase without the human serum albumin or human serum albumin variant.

2. The fusion protein of claim 1, wherein the mutant human DNase is operably coupled to the N-terminus of the human serum albumin, or human serum albumin variant, and the human RNase is operably coupled to the C-terminus of the human serum albumin, or human serum albumin variant.

3. The fusion protein of claim 2, wherein the mutant human DNase and human RNase are operably coupled to the N- and C-terminus, respectively, of the human serum albumin, or human serum albumin variant, via a linker.

4. The fusion protein of claim 1, wherein the human RNase is a wild type human RNase.

5. The fusion protein of claim 3, wherein the linker is a polypeptide linker.

6. The fusion protein of claim 1, wherein the fusion protein is selected from the group consisting of: (i) a fusion protein comprising an amino acid sequence set forth in SEQ ID NO: 112-114 or 120-122, or (ii) a fusion protein comprising an amino acid sequence at least 90% identical to the amino acid sequence set forth in SEQ ID NO: 112-114 or 120-122 and having increased serum half-life relative to a fusion protein comprising a human mutant DNase and a human RNase without a human serum albumin or a human serum albumin variant.

7. The fusion protein of claim 1, wherein the mutant human DNase is operably coupled to the C-terminus of the human serum albumin, or human serum albumin variant, and the human RNase is operably coupled to the N-terminus of the human serum albumin, or human serum albumin variant.

8. The fusion protein of claim 7, wherein the mutant human DNase and human RNase are operably coupled to the C- and N-terminus, respectively, of the human serum albumin, or human serum albumin variant, via a linker.

9. The fusion protein of claim 1, wherein the fusion protein comprises a first linker, a second linker, or both, wherein when the fusion protein comprises a first linker, the mutant human DNase is operably coupled to the human serum albumin, or human serum albumin variant, by the first linker, and wherein when the fusion protein comprises a second linker, the human RNase is operably coupled to the human serum albumin, or human serum albumin variant, by the second linker.

10. The fusion protein of claim 9, wherein the fusion protein comprises a first linker and a second linker.

11. The fusion protein of claim 9, wherein the first linker, the second linker, or both, comprise a polypeptide linker.

12. The fusion protein of claim 11, wherein the polypeptide linker of the first linker, the second linker, or both, is a gly-ser linker.

13. The fusion protein of claim 5, wherein the polypeptide linker is a gly-ser linker.

14. The fusion protein of claim 1, further comprising a leader sequence.

15. The fusion protein of claim 14, wherein the leader sequence is a VK3LP peptide, and wherein the leader sequence is coupled to the N-terminus of the mutant human DNase or the N-terminus of the human RNase.

16. The fusion protein of claim 1, wherein the mutant human DNase comprises the amino acid sequence set forth in SEQ ID NO: 108 or an amino acid sequence at least 90% identical to the amino acid sequence set forth in SEQ ID NO: 108.

17. The fusion protein of claim 1, wherein the RNase comprises the amino acid sequence set forth in SEQ ID NO: 75.

18. The fusion protein of claim 1, wherein the human serum albumin comprises the amino acid sequence set forth in SEQ ID NO: 1.

19. The fusion protein of claim 14, wherein the leader sequence comprises the amino acid sequence set forth in SEQ ID NO: 86.

20. The fusion protein of claim 1, wherein the fusion protein is selected from the group consisting of: (i) a fusion protein comprising an amino acid sequence set forth in SEQ ID NO: 113, or (ii) a fusion protein comprising an amino acid sequence at least 90% identical to the amino acid sequence set forth in SEQ ID NO: 113 and having increased serum half-life relative to a fusion protein comprising a human mutant DNase and a human RNase without a human serum albumin or a human serum albumin variant.

21. The fusion protein of claim 1, wherein the fusion protein is selected from the group consisting of: (i) a fusion protein comprising the amino acid sequence set forth in SEQ ID NO: 121, or (ii) a fusion protein comprising an amino acid sequence at least 90% identical to the amino acid sequence set forth in SEQ ID NO: 121 and having increased serum half-life relative to a fusion protein comprising a human mutant DNase and a human RNase without a human serum albumin or a human serum albumin variant.

22. A composition comprising the fusion protein of claim 1 and a pharmaceutically acceptable carrier.

23. A composition comprising the fusion protein of claim 6 and a pharmaceutically acceptable carrier.

24. A composition comprising the fusion protein of claim 20 and a pharmaceutically acceptable carrier.

25. A composition comprising the fusion protein of claim 21 and a pharmaceutically acceptable carrier.

26. The fusion protein of claim 1, wherein the variant of human serum albumin comprises an amino acid sequence at least 95% identical to the amino acid sequence set forth in SEQ ID NO: 1.

27. The fusion protein of claim 1, which degrades circulating RNA and/or DNA and RNA and/or DNA in immune complexes, or inhibits interferon-α production, or both.

28. The fusion protein of claim 1, wherein the variant of the human serum albumin binds FcRn with a higher affinity than that for a corresponding wild type human serum albumin.

29. A fusion protein comprising:
(i) a DNase comprising one or more mutations selected from E13R, N74K, A114F, and T205K, wherein the mutation numbering corresponds to SEQ ID NO: 66, operably coupled, with or without a linker, to
(ii) a human serum albumin, operably coupled, with or without a linker, to
(iii) a human RNase; and
wherein the fusion protein has increased serum half-life relative to a fusion protein comprising the human mutant DNase and the human RNase without the human serum albumin.

30. A fusion protein comprising:
(i) a DNase comprising one or more mutations selected from E13R, N74K, A114F, and T205K, wherein the mutation numbering corresponds to SEQ ID NO: 66, operably coupled, with a first linker, to
(ii) a human serum albumin, operably coupled, with a second linker domain, to
(iii) a human RNase; and
wherein the fusion protein has increased serum half-life relative to a fusion protein comprising the human mutant DNase and the human RNase without the human serum albumin.

31. The fusion protein of claim 30, wherein the first linker, the second linker, or both, comprise a polypeptide linker.

32. The fusion protein of claim 31, wherein the polypeptide linker of the first linker, the second linker, or both, is a gly-ser linker.

33. The fusion protein of claim 31, wherein the polypeptide linker of the first linker and the second linker is a gly-ser linker.

34. The fusion protein of claim 31, wherein the polypeptide linker of the first linker, the second linker, or both is an NLG linker.

35. The fusion protein of claim 31, wherein the first linker is an NLG linker, and wherein the second linker is a gly-ser linker.

36. The fusion protein of claim 32, wherein the gly-ser linker is (Gly$_4$Ser)$_3$.

37. The fusion protein of claim 33, wherein the gly-ser linker is (Gly$_4$Ser)$_3$.

38. The fusion protein of claim 1, wherein the mutant human DNase comprises the mutations E13R, N74K, A114F, and T205K, wherein the mutation numbering corresponds to SEQ ID NO: 66.

39. The fusion protein of claim 30, wherein the mutant human DNase comprises the mutations E13R, N74K, A114F, and T205K, wherein the mutation numbering corresponds to SEQ ID NO: 66.

40. The fusion protein of claim 1, wherein the human serum albumin comprises an amino acid sequence at least 90% identical to the amino acid sequence set forth in SEQ ID NO: 1.

41. The fusion protein of claim 1, wherein the human serum albumin comprises an amino acid sequence at least 95% identical to the amino acid sequence set forth in SEQ ID NO: 1.

42. The fusion protein of claim 1, wherein the fusion protein is selected from the group consisting of: (i) a fusion protein comprising an amino acid sequence set forth in SEQ ID NO: 112, or (ii) a fusion protein comprising an amino acid sequence at least 90% identical to the amino acid sequence set forth in SEQ ID NO: 112 and having increased serum half-life relative to a fusion protein comprising a human mutant DNase and a human RNase without a human serum albumin or a human serum albumin variant.

43. The fusion protein of claim 1, wherein the fusion protein is selected from the group consisting of: (i) a fusion protein comprising the amino acid sequence set forth in SEQ ID NO: 120, or (ii) a fusion protein comprising an amino acid sequence at least 90% identical to the amino acid sequence set forth in SEQ ID NO: 120 and having increased serum half-life relative to a fusion protein comprising a human mutant DNase and a human RNase without a human serum albumin or a human serum albumin variant.

44. The fusion protein of claim 1, wherein the fusion protein is selected from the group consisting of: (i) a fusion protein comprising an amino acid sequence set forth in SEQ ID NO: 114, or (ii) a fusion protein comprising an amino acid sequence at least 90% identical to the amino acid sequence set forth in SEQ ID NO: 114 and having increased serum half-life relative to a fusion protein comprising a human mutant DNase and a human RNase without a human serum albumin or a human serum albumin variant.

45. The fusion protein of claim 1, wherein the fusion protein is selected from the group consisting of: (i) a fusion protein comprising the amino acid sequence set forth in SEQ ID NO: 122, or (ii) a fusion protein comprising an amino acid sequence at least 90% identical to the amino acid sequence set forth in SEQ ID NO: 122 and having increased serum half-life relative to a fusion protein comprising a human mutant DNase and a human RNase without a human serum albumin or a human serum albumin variant.

46. A composition comprising the fusion protein of claim 29 and a pharmaceutically acceptable carrier.

47. A composition comprising the fusion protein of claim 30 and a pharmaceutically acceptable carrier.

48. A composition comprising the fusion protein of claim 33 and a pharmaceutically acceptable carrier.

49. A composition comprising the fusion protein of claim 37 and a pharmaceutically acceptable carrier.

50. A composition comprising the fusion protein of claim 39 and a pharmaceutically acceptable carrier.

51. A composition comprising the fusion protein of claim 42 and a pharmaceutically acceptable carrier.

52. A composition comprising the fusion protein of claim 43 and a pharmaceutically acceptable carrier.

53. A composition comprising the fusion protein of claim 44 and a pharmaceutically acceptable carrier.

54. A composition comprising the fusion protein of claim 45 and a pharmaceutically acceptable carrier.

* * * * *